US011104724B2

(12) United States Patent
Torres et al.

(10) Patent No.: US 11,104,724 B2
(45) Date of Patent: Aug. 31, 2021

(54) COMPOSITIONS AND METHODS FOR ANTIBODIES TARGETING STAPHYLOCOCCAL LEUKOTOXINS

(71) Applicants: NEW YORK UNIVERSITY, New York, NY (US); JANSSEN BIOTECH, INC., Horsham, PA (US)

(72) Inventors: Victor J. Torres, New York, NY (US); Anthony S. Lynch, Spring House, PA (US); Peter T. Buckley, Spring House, PA (US); Nathan Majewski, Spring House, PA (US)

(73) Assignees: NEW YORK UNIVERSITY, New York, NY (US); JANSSEN BIOTECH, INC., Horsham, PA (US)

( * ) Notice: Subject to any disclaimer, the term of this patent is extended or adjusted under 35 U.S.C. 154(b) by 201 days.

(21) Appl. No.: 16/303,666

(22) PCT Filed: May 23, 2017

(86) PCT No.: PCT/US2017/034009
§ 371 (c)(1),
(2) Date: Nov. 21, 2018

(87) PCT Pub. No.: WO2017/205377
PCT Pub. Date: Nov. 30, 2017

(65) Prior Publication Data
US 2020/0317758 A1    Oct. 8, 2020

Related U.S. Application Data

(60) Provisional application No. 62/340,019, filed on May 23, 2016.

(51) Int. Cl.
*C07K 16/12* (2006.01)
(52) U.S. Cl.
CPC .... *C07K 16/1271* (2013.01); *C07K 2317/565* (2013.01); *C07K 2317/76* (2013.01); *C07K 2317/92* (2013.01)

(58) Field of Classification Search
None
See application file for complete search history.

(56) References Cited

U.S. PATENT DOCUMENTS

| 2008/0025913 | A1 | 1/2008 | Bowdish et al. |
| 2010/0068199 | A1 | 3/2010 | Liang et al. |
| 2013/0251733 | A1 | 9/2013 | Youd et al. |
| 2014/0294765 | A1 | 10/2014 | Cojocaru et al. |
| 2015/0274814 | A1 | 10/2015 | Torres et al. |

FOREIGN PATENT DOCUMENTS

| WO | 2014187746 A2 | 11/2014 |
| WO | 2015/031578 A1 | 3/2015 |
| WO | 2015/091935 A2 | 6/2015 |
| WO | 2015/200522 A2 | 12/2015 |

OTHER PUBLICATIONS

PCT International Search Report and Written Opinion for corresponding PCT/US2017/034009, dated Dec. 11, 2017.
European Search Report EP17803422.9 (dated Apr. 17, 2020).
Thomsen et al., "Monoclonal Antibodies Against the Staphylococcus Aureus Bicomponent Leukotoxin AB Isolated Following Invasive Human Infection Reveal Diverse Binding and Modes of Action," Journal of Infectious Diseases 215 (7):1124-1131 (2017).
European Extended Search Report EP17803422.9 (dated Jul. 23, 2020).

*Primary Examiner* — Sarvamangala Devi
(74) *Attorney, Agent, or Firm* — Troutman Pepper Hamilton Sanders LLP (Rochester)

(57) ABSTRACT

The disclosure is directed to antibodies that bind to *Staphylococcus aureus* bi-component leukotoxins and/or gamma-hemolysins. Other aspects of the disclosure are directed to pharmaceutical compositions and diagnostic kits containing the leukotoxin and hemolysin antibodies, and therapeutic and diagnostic methods utilizing the leukotoxin and hemolysin antibodies.

4 Claims, 20 Drawing Sheets
Specification includes a Sequence Listing.

Binding steps:

A: Loading of biotinylated LukD
B: Baseline (PBS)
C: Association of SM1B221
D: Baseline (PBS)
E: Association of SM1B221 (grey) or SM1B225 (black)
F: Dissociation (PBS)

Binding steps:
A: Loading of biotinylated LukD
B: Baseline (PBS)
C: Association of SM1B225
D: Baseline (PBS)
E: Association of SM1B221 (grey)
   or SM1B225 (black)
F: Dissociation (PBS)

| AA residues in LukE (SEQ ID # 826) | Protected Sequence | Fab SM1B438 | Fab SM1B440 | Fab SM1B709 |
|---|---|---|---|---|
| 60-68 | KMQGFINSR | - | + | - |
| 74-82 | VKGSGYELT | - | - | ++ |
| 115-158 | TTDVGQTLGYNIGGNFQS APSIGGNGSFNYSKTISYT QKSYVSE | - | + | - |
| 192-206 | VQSPNGPTGSAREYF | - | - | ++ |
| 207-219 | APDNQLPPLVQSG | ++ | ++ | - |
| 207-224 | APDNQLPPLVQSGFNPSF | - | ++ | - |
| 255-275 | LFPRTGIYAERKHNAFVN RNF | - | - | ++ |

"-" indicates no detectable reduction in deuterium uptake upon Fab binding.
"+" indicates detectable reduction in deuterium uptake upon Fab binding.
"++" indicates significant reduction in deuterium uptake upon Fab binding.

FIG. 4

COMPOSITIONS AND METHODS FOR ANTIBODIES TARGETING STAPHYLOCOCCAL LEUKOTOXINS

This application is a national stage application under 35 U.S.C. § 371 of PCT Application No. PCT/US2017/034009, filed May 23, 2017, which claims the priority benefit of U.S. Provisional Patent Application Ser. No. 62/340,019, filed May 23, 2016, which are hereby incorporated by reference in their entirety.

FIELD OF THE INVENTION

The present invention relates to *Staphylococcus aureus* leukotoxin antibodies, gamma-hemolysin antibodies, and compositions containing the same. Also disclosed are therapeutic and diagnostic methods using the leukotoxin and gamma hemolysin antibodies.

BACKGROUND

Bacterial infections caused by *staphylococcus* bacteria (i.e., a "staph infection") are very common in the general population. About 25% of individuals commonly carry *staphylococcus* bacteria on their skin or in their nose. Most of the time, these bacteria do not cause a problem or may cause a relatively minor skin infection. However, staph infections can turn deadly if the bacteria invade deeper into an individual's body, for example, entering the bloodstream, joints, bones, lungs or heart. In the past, a lethal staph infection might have occurred in a person who was hospitalized or had a chronic illness or weakened immune system. Now, it is increasingly common for an otherwise healthy individual to develop life-threatening staph infections. Importantly, many staph infections have become antibiotic resistant.

*Staphylococcus aureus*, often referred to as "staph," Staph. *aureus*," or "*S. aureus*," is a major human pathogen, producing a multitude of virulence factors making it able to cause several types of infection, from superficial lesions to toxinoses and life-threatening systemic conditions such as endocarditis, osteomyelitis, pneumonia, meningitis and sepsis (reviewed in Miller and Cho, "Immunity Against *Staphylococcus aureus* Cutaneous Infections," *Nat. Rev. Immunol.* 11:505-518 (2011)). Although most individuals encounter *S. aureus* shortly after birth (Holtfreter et al., "Towards the Immune Proteome of *Staphylococcus aureus*—The Anti-*S. aureus* Antibody Response," *Int. J. Med. Microbiol.* 300: 176-192 (2010)) and possess both antibodies against *S. aureus* and the ability to increase anti-*S. aureus* titers after infection, these antibodies are often not protective against recurrent *S. aureus* infections (Foster T J, "Immune Evasion by Staphylococci," *Nat. Rev. Microbiol.* 3:948-958 (2005)). In the United States alone, an annual mortality of more than 20,000 is attributed to methicillin-resistant *S. aureus* (MRSA), exceeding deaths caused by influenza, viral hepatitis, and HIV/AIDS (Foster, T J., "Immune Evasion by Staphylococci," *Nat. Rev. Microbiol.* 3:948-958 (2005); Klevens et al., "The Impact of Antimicrobial-Resistant, Health Care-Associated Infections on Mortality in the United States," *Clin. Infect. Dis.* 47:927-930 (2008)).

The pathogen produces a variety of molecules that presumably facilitate survival in or on the human host. Bi-component, pore-forming leukotoxins and gamma hemolysins are among the secreted virulence factors produced by *S. aureus*. These toxins are secreted as water soluble monomers which oligomerize, and insert pores into the plasma membrane of host cells, most notably polymorphonuclear leukocytes (PMNs) and mononuclear phagocytes (Alonzo F. and Torres V., "*Staphylococcus aureus* Bi-component leukotoxins," *Microbiol. Mol. Biol. Rev.* 78(2): 199-230 (2014)). These pores disrupt cellular osmotic balance and membrane potential leading to death of the targeted cells. In the case of Leukotoxin ED (LukED), the targeting, binding, and killing of host phagocytic cells occurs via the cellular target CCR5, CXCR1 and CXCR2 located on the surface of the phagocytes (Alonzo III et al., "*Staphylococcus aureus* Leucocidin ED Contributes to Systemic Infection by Targeting Neutrophils and Promoting Bacterial Growth In Vivo," *Mol. Microbiol.* 83:423-435 (2012); Alonzo III et al. "CCR5 is a Receptor for *Staphylococcus aureus* Leukotoxin ED," Nature 493(7430)51-55 (2012); and Reyes-Robles et al., "*Staphylococcus aureus* Leukotoxin ED Targets the Chemokine Receptors CXCR1 and CXCR2 to Kill Leukocytes and Promote Infection," *Cell Host & Microbe* 14:453-459 (2013)). Indeed, when the cellular target of LukED, CCR5, is not present on host immune cells, the host animal is resistant to the otherwise lethal *S. aureus* infection (Alonzo III et al. "CCR5 is a Receptor for *Staphylococcus aureus* Leukotoxin ED," *Nature* 493(7430):51-55 (2012)). Leukotoxin AB (LukAB) can also kill host phagocytic cells, and its cytolytic activity can be exerted both from the outside and the inside of the cell, i.e., after the microorganism is phagocytosed into the host cell (Dumont et al., "*Staphylococcus aureus* LukAB Cytotoxin Kills Human Neutrophils by Targeting the CD11b Subunit of the Integrin Mac-1,*"* *PNAS* 110(26):10794-10799 (2013)). Due to the contribution that both of these leukotoxins as well as related bi-component toxins have to pathogenesis, they have been considered critical *S. aureus* virulence factors and targets for therapeutic intervention (Alonzo III and Torres, "Bacterial Survival Amidst an Immune Onslaught: The Contribution of the *Staphylococcus aureus* Leukotoxins," *PLOS Path* 9(2): e1003143 (2013)). However, antibody compositions suitable for therapeutic and/or diagnostic applications are currently not available.

The present invention is directed to overcoming these and other deficiencies in the art.

SUMMARY

One aspect of the present disclosure relates to antibodies or binding portions thereof that bind *Staphylococcus aureus* Leukocidin AB (LukAB). A LukAB antibody or binding portion thereof as described herein comprises a heavy chain variable region that comprises: a complementarity-determining region 1 (CDR-H1) comprising an amino acid sequence of any one of SEQ ID NOs: 1-20, or a modified amino acid sequence of any one of SEQ ID NOs: 1-20, said modified sequence having at least 80% sequence identity to any one of SEQ ID NOs: 1-20; a complementarity-determining region 2 (CDR-H2) comprising an amino acid sequence of any one of SEQ ID NOs: 21-41, or a modified amino acid sequence of any one of SEQ ID NOs: 21-41, said modified sequences having at least 80% sequence identity to any one of SEQ ID NOs: 21-41; and a complementarity-determining region 3 (CDR-H3) comprising an amino acid sequence of any one of SEQ ID NOs: 42-62, or a modified amino acid sequence of any one of SEQ ID NO:42-62, said modified sequence having at least 80% sequence identity to any one of SEQ ID NOs: 42-62.

Another aspect of the present disclosure relates to an antibody or binding portion thereof that competes for leukocidin AB binding with a monoclonal antibody, wherein said monoclonal antibody comprises a heavy chain variable region comprising a CDR-H1 of SEQ ID NO: 11, a CDR-H2 of SEQ ID NO: 31, and a CDR-H3 of SEQ ID NO: 53, and a light chain variable region comprising a CDR-L1 of SEQ ID NO: 66, a CDR-L2 of SEQ ID NO: 92, and a CDR-L3 of SEQ ID NO: 117.

Another aspect of the present disclosure relates to antibodies or binding portions thereof that bind *Staphylococcus aureus* Leukocidin E (LukE). A LukE antibody or binding portion thereof as described herein comprises a heavy chain variable region that comprises: a complementarity-determining region 1 (CDR-H1) comprising an amino acid sequence of any one of SEQ ID NOs: 287-291, or a modified amino acid sequence of any one of SEQ ID NOs: 287-291, said modified sequence having at least 80% sequence identity to any one of SEQ ID NOs: 287-291; a complementarity-determining region 2 (CDR-H2) comprising an amino acid sequence of any one of SEQ ID NOs: 292-296, or a modified amino acid sequence of any one of SEQ ID NOs: 292-296, said modified sequence having at least 80% sequence identity to any one of SEQ ID NOs: 292-296; and a complementarity-determining region 3 (CDR-H3) comprising an amino acid sequence of any one of SEQ ID NOs: 297-302, or a modified amino acid sequence of any one of SEQ ID NO: 297-302 said modified sequence having at least 80% sequence identity to any one of SEQ ID NOs: 297-302.

Another aspect of the present disclosure is directed to an antibody or binding portion thereof that competes for leukocidin E binding with a monoclonal antibody, wherein said monoclonal antibody comprises a heavy chain variable region comprising a CDR-H1 of SEQ ID NO: 290, a CDR-H2 of SEQ ID NO: 295, and a CDR-H3 of SEQ ID NO: 301, and a light chain variable region comprising the CDR-L1 of SEQ ID NO: 308, the CDR-L2 of SEQ ID NO: 311, and the CDR-L3 of SEQ ID NO: 321.

Another aspect of the present disclosure relates to antibodies or binding portions thereof that bind *Staphylococcus aureus* Leukocidin D (LukD). A LukD antibody or binding portion thereof of the present disclosure comprises a heavy chain variable region that comprises: a complementarity-determining region 1 (CDR-H1) comprising an amino acid sequence of any one of SEQ ID NOs: 372-374, or a modified amino acid sequence of any one of SEQ ID NOs: 372-374, said modified sequence having at least 80% sequence identity to any one of SEQ ID NOs: 372-374; a complementarity-determining region 2 (CDR-H2) comprising an amino acid sequence of any one of SEQ ID NOs: 375-379, or a modified amino acid sequence of any one of SEQ ID NOs: 375-379, said modified sequences having at least 80% sequence identity to any one of SEQ ID NOs: 375-379; and a complementarity-determining region 3 (CDR-H3) comprising an amino acid sequence of any one of SEQ ID NOs: 380-383, or a modified amino acid sequence of any one of SEQ ID NO: 380-383, said modified sequence having at least 80% sequence identity to any one of SEQ ID NOs: 380-383.

Another aspect of the present disclosure relates to an antibody or binding portion thereof that competes for leukocidin D binding with a monoclonal antibody, where the monoclonal antibody comprises: (i) a heavy chain variable region comprising the CDR-H1 of SEQ ID NO: 373, the CDR-H2 of SEQ ID NO: 378, and the CDR-H3 of SEQ ID NO: 382, and a light chain variable region comprising the CDR-L1 of SEQ ID NO: 387, the CDR-L2 of SEQ ID NO: 390, and the CDR-L3 of SEQ ID NO: 395; (ii) a heavy chain variable region comprising the CDR-H1 of SEQ ID NO: 372, the CDR-H2 of SEQ ID NO: 375, and the CDR-H3 of SEQ ID NO: 380, and a light chain variable region comprising the CDR-L1 of SEQ ID NO: 386, the CDR-L2 of SEQ ID NO: 388, and the CDR-L3 of SEQ ID NO: 396; (iii) a heavy chain variable region comprising the CDR-H1 of SEQ ID NO: 374, the CDR-H2 of SEQ ID NO: 379, and the CDR-H3 of SEQ ID NO: 383, and a light chain variable region comprising the CDR-L1 of SEQ ID NO: 386, the CDR-L2 of SEQ ID NO: 391, and the CDR-L3 of SEQ ID NO: 397; or (iv) a heavy chain variable region comprising the CDR-H1 of SEQ ID NO: 372, the CDR-H2 of SEQ ID NO: 375, and the CDR-H3 of SEQ ID NO: 380, and a light chain variable region comprising the CDR-L1 of SEQ ID NO: 386, the CDR-L2 of SEQ ID NO: 388, and the CDR-L3 of SEQ ID NO: 392

Another aspect of the present disclosure is directed to antibodies or binding portions thereof that bind *Staphylococcus aureus* gamma-hemolysin A (HlgA). A HlgA antibody or binding portion thereof as described herein comprises a heavy chain variable region that comprises: a complementarity-determining region 1 (CDR-H1) comprising an amino acid sequence of any one of SEQ ID NOs: 430-432, or a modified amino acid sequence of any one of SEQ ID NOs: 430-432, said modified sequence having at least 80% sequence identity to any one of SEQ ID NOs: 430-432; a complementarity-determining region 2 (CDR-H2) comprising an amino acid sequence of any one of SEQ ID NOs: 433-435, or a modified amino acid sequence of any one of SEQ ID NOs: 433-435, said modified sequence having at least 80% sequence identity to any one of SEQ ID NOs: 433-435; and a complementarity-determining region 3 (CDR-H3) comprising an amino acid sequence of any one of SEQ ID NOs: 436-438, or a modified amino acid sequence of any one of SEQ ID NO: 436-438, said modified sequence having at least 80% sequence identity to any one of SEQ ID NOs: 436-438.

Another aspect of the present disclosure relates to an antibody or binding portion thereof that competes for HlgA binding to a monoclonal antibody, wherein the monoclonal antibody comprises: a heavy chain variable region comprising the CDR-H1 of SEQ ID NO: 432, the CDR-H2 of SEQ ID NO: 435, and the CDR-H3 of SEQ ID NO: 438 and a light chain variable region comprising the CDR-L1 of SEQ ID NO: 439, the CDR-L2 of SEQ ID NO: 441, and the CDR-L3 of SEQ ID NO: 444.

Another aspect of the present disclosure is directed to antibodies or binding portions thereof that bind *Staphylococcus aureus* gamma-hemolysin C (HlgC). A HgC antibody or binding portion thereof of the present disclosure comprises a heavy chain variable region that comprises: a complementarity-determining region 1 (CDR-H1) comprising an amino acid sequence of SEQ ID NO: 470, or a modified amino acid sequence of SEQ ID NO: 470, said modified sequence having at least 80% sequence identity to SEQ ID NO: 470; a complementarity-determining region 2 (CDR-H2) comprising an amino acid sequence of SEQ ID NO: 471, or a modified amino acid sequence of SEQ ID NO: 471, said modified sequence having at least 80% sequence identity to SEQ ID NO: 471; and a complementarity-determining region 3 (CDR-H3) comprising an amino acid sequence of SEQ ID NO: 472, or a modified amino acid sequence of SEQ ID NO: 472, said modified sequence having at least 80% sequence identity to SEQ ID NO: 472.

Another aspect of the present disclosure is directed to an antibody or binding portion thereof that competes for HlgC binding to a monoclonal antibody, where the monoclonal antibody comprises: a heavy chain variable region comprising the CDR-H1 of SEQ ID NO: 470, the CDR-H2 of SEQ ID NO: 471, and the CDR-H3 of SEQ ID NO: 472 and a light chain variable region comprising the CDR-L1 of SEQ ID NO: 474, the CDR-L2 of SEQ ID NO: 479, and the CDR-L3 of SEQ ID NO: 484.

Another aspect of the present disclosure relates to antibodies or binding portions thereof that bind *Staphylococcus aureus* LukE and/or HlgA. A LukE and/or HlgA antibody or binding portion thereof of the present disclosure comprises a heavy chain variable region that comprises: a complementarity-determining region 1 (CDR-H1) comprising an amino acid sequence of any one of SEQ ID NOs: 513-529, or a modified amino acid sequence of any one of SEQ ID NOs: 513-529, said modified sequence having at least 80% sequence identity to any one of SEQ ID NOs: 513-529; a complementarity-determining region 2 (CDR-H2) comprising an amino acid sequence of any one of SEQ ID NOs: 530-548, or a modified amino acid sequence of any one of SEQ ID NOs: 530-548, said modified sequences having at least 80% sequence identity to any one of SEQ ID NOs: 530-548; and a complementarity-determining region 3 (CDR-H3) comprising an amino acid sequence of any one of SEQ ID NOs: 549-568, or a modified amino acid sequence of any one of SEQ ID NO: 549-568, said modified sequence having at least 80% sequence identity to any one of SEQ ID NOs: 549-568.

Another aspect of the present disclosure relates to an antibody or binding portion thereof that competes for LukE and/or HlgA binding with a monoclonal antibody, where the monoclonal antibody comprises: (i) a heavy chain variable region comprising the CDR-H1 of SEQ ID NO: 519, the CDR-H2 of SEQ ID NO: 537, and the CDR-H3 of SEQ ID NO: 556, and a light chain variable region comprising the CDR-L1 of SEQ ID NO: 576, the CDR-L2 of SEQ ID NO: 608, and the CDR-L3 of SEQ ID NO: 629; (ii) a heavy chain variable region comprising the CDR-H1 of SEQ ID NO: 521, the CDR-H2 of SEQ ID NO: 539, and the CDR-H3 of SEQ ID NO: 558, and a light chain variable region comprising the CDR-L1 of SEQ ID NO: 578, the CDR-L2 of SEQ ID NO: 608, and the CDR-L3 of SEQ ID NO: 631; (iii) a heavy chain variable region comprising the CDR-H1 of SEQ ID NO: 522, the CDR-H2 of SEQ ID NO: 540, and the CDR-H3 of SEQ ID NO: 558, and a light chain variable region comprising the CDR-L1 of SEQ ID NO: 583, the CDR-L2 of SEQ ID NO: 608, and the CDR-L3 of SEQ ID NO: 631; (iv) a heavy chain variable region comprising the CDR-H1 of SEQ ID NO: 523, the CDR-H2 of SEQ ID NO: 541, and the CDR-H3 of SEQ ID NO: 559, and a light chain variable region comprising the CDR-L1 of SEQ ID NO: 584, the CDR-L2 of SEQ ID NO: 608, and the CDR-L3 of SEQ ID NO: 631; (v) a heavy chain variable region comprising the CDR-H1 of SEQ ID NO: 524, the CDR-H2 of SEQ ID NO: 542, and the CDR-H3 of SEQ ID NO: 560, and a light chain variable region comprising the CDR-L1 of SEQ ID NO: 589, the CDR-L2 of SEQ ID NO: 615, and the CDR-L3 of SEQ ID NO:642; (vi) a heavy chain variable region comprising the CDR-H1 of SEQ ID NO: 525, the CDR-H2 of SEQ ID NO: 543, and the CDR-H3 of SEQ ID NO: 561 and a light chain variable region comprising the CDR-L1 of SEQ ID NO: 590, the CDR-L2 of SEQ ID NO: 601, and the CDR-L3 of SEQ ID NO: 643; and (vii) a heavy chain variable region comprising the CDR-H1 of SEQ ID NO: 527, the CDR-H2 of SEQ ID NO: 545 and the CDR-H3 of SEQ ID NO: 563, and a light chain variable region comprising the CDR-L1 of SEQ ID NO: 596, the CDR-L2 of SEQ ID NO: 620, and the CDR-L3 of SEQ ID NO: 649.

Other aspects of the present disclosure are directed to isolated polynucleotides encoding the various *S. aureus* antibodies described herein, vectors comprising the isolated polynucleotide, and cells comprising these vectors.

Additional aspects of the present disclosure are directed to pharmaceutical compositions comprising a *S. aureus* antibody as described herein and a pharmaceutical carrier, as well as methods of treating and inhibiting the onset of a staphylococcal infection in a subject using the pharmaceutical compositions described herein.

Other aspects of the present disclosure are directed to methods of detecting *S. aureus* in a biological sample using a *S. aureus* antibody as described herein and diagnostic kits containing the *S. aureus* antibodies described herein.

The tremendous success of *S. aureus* as a pathogen is in part due to its ability to express an arsenal of factors that harm the host. Among these factors are a number of bi-component protein toxins that are secreted into the extracellular milieu where they act by killing host cells. The staphylococcal antibodies and binding portions thereof described herein recognize, bind, and neutralize these bi-component staphylococcal toxins, thereby providing unique therapeutic, prophylactic, and diagnostic agents and approaches for combatting staphylococcal infection.

BRIEF DESCRIPTION OF THE DRAWINGS

FIG. 1A shows the binding of anti-LukD mAbs SM1B221 and SM1B225 to LukD protein as determined by ELISA. FIG. 1B shows differential activity of anti-LukD mAbs SM1B221 and SM1B225 in neutralizing the cytolytic activity of the LukED leukotoxin against human primary polymorphonuclear leukocytes. FIG. 1C shows differential activity of anti-LukD mAbs SM1B221 and SM1B225 in neutralizing the cytolytic activity of the LukED leukotoxin against human primary polymorphic nuclear leukocytes. FIG. 1D shows competition binding studies of anti-LukD mAbs SM1B221 and SM1B225 for LukD determined using a bio-layer interferometry assay. FIG. 1E shows competition binding studies of anti-LukD mAbs SM1B221 and SM1B225 for LukD determined using a bio-layer interferometry assay.

FIGS. 2A-I depict the characterization of monoclonal antibodies that bind the LukAB leukotoxin via non-competing epitopes and exhibit differential effects on LukAB activity. FIG. 2A shows binding of anti-LukAB mAbs SM1B111, SM1B245, SM1B249 and SM1B252 to LukAB protein as determined by ELISA. FIG. 2B shows differential activity of anti-LukAB mAbs SM1B245, SM1B249 and SM1B252 on neutralizing the cytolytic activity of the LukAB leukotoxin against human primary polymorphonuclear leukocytes. FIG. 2C shows differential activity of anti-LukAB mAbs SM1B245, SM1B249 and SM1B252 in neutralizing the cytolytic activity of the LukAB leukotoxin against human primary polymorphonuclear leukocytes. FIGS. 2D-E shows competition binding studies of anti-LukAB mAbs SM1B111, SM1B245 and SM1B249 determined using a bio-layer interferometry assay. FIGS. 2F-G show competition binding studies of anti-LukAB mAbs SM1B111, SM1B245 and SM1B249 determined using a bio-layer interferometry assay. FIGS. 2H-I show competition binding studies of anti-LukAB mAbs SM1B111, SM1B245 and SM1B249 determined using a bio-layer interferometry assay.

FIG. 3A shows the binding of the anti-LukE mAbs SM1B318 and SM1B332 to purified LukE protein as determined by an ELISA. FIGS. 3B-D show competition binding studies of anti-LukE mAbs SM1B318, SM1B332, and SM1B507 determined using a bio-layer interferometry assay. FIG. 3E shows the differential activity of the anti-LukE mAbs SM1B318, SM1B322 and SM1B507 and the anti-LukD mAb SM1B221 to inhibit the cytolytic activity of LukED against human primary polymorphonuclear leukocytes.

FIG. 4 shows a tabular summary of data from Hydrogen/Deuterium Exchange Mass Spectrometry analysis of the binding of Fabs SM1B438, SM1B440, and SM1B709 to LukE protein.

DETAILED DESCRIPTION

Figure 1A:
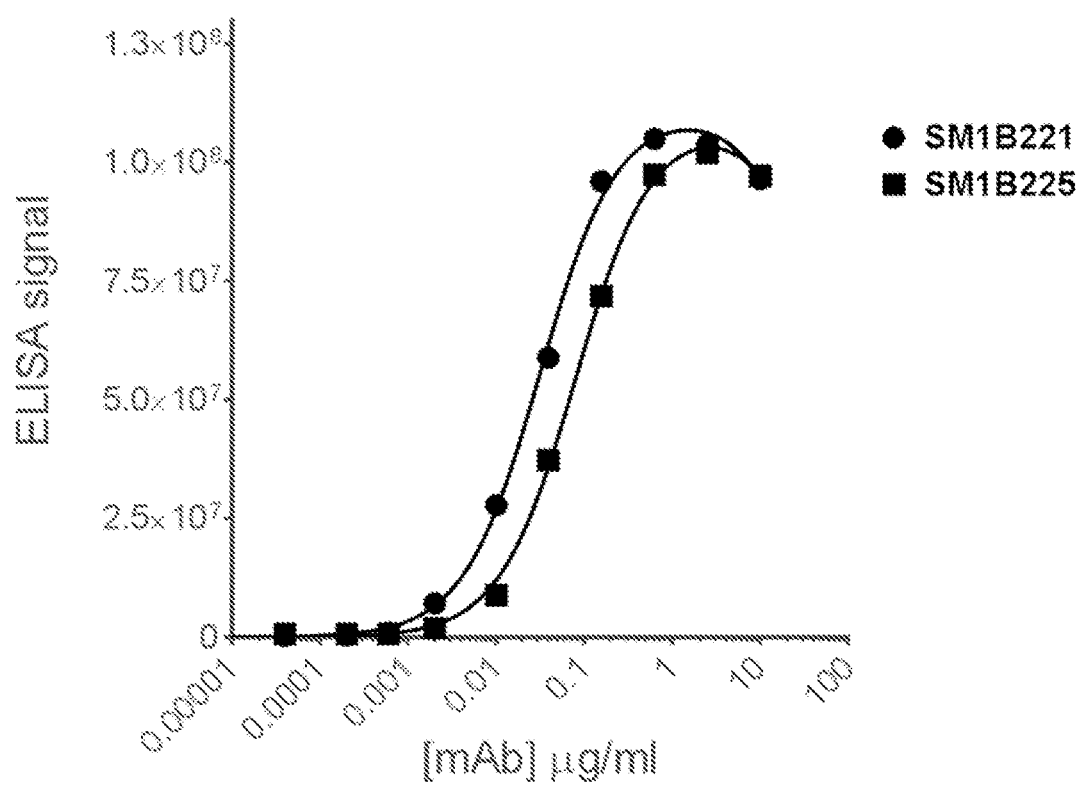
FIGS. 1A-E depict the characterization of monoclonal antibodies that bind leukotoxin subunit LukD via non-competing epitopes and exhibit differential LukED neutralization activity.

*Staphylococcus aureus* possesses virulence factors that afford it the ability to colonize, persist, disseminate, and evade the immune system of an infected host. One such set of virulence factors include the bi-component pore-forming family of hemolysins and leucocidins (also referred to herein as leukotoxins). The pore forming activity of these toxins requires the concerted action of two polypeptides, i.e., an S (slow)-subunit polypeptide and an F (fast)-subunit polypeptide. These bi-component pore-forming toxins include (i) γ-hemolysin comprised of an S-subunit of HlgA or HlgC with an F-subunit of HlgB, (ii) the Pantone-Valentine Leukocidin (PVL), made of leukocidin S-PV (LukS-PV) and LukF-PV, (iii) LukED made of S-subunit LukE and F-subunit LukD, and (iv) LukAB made of S-subunit LukA and F-subunit LukB. The present disclosure relates generally to antibodies and binding portions thereof that bind to, and in some cases neutralize, one or more of these staphylococcal bi-component leukotoxins and/or gamma hemolysin toxins. The present disclosure also relates to therapeutic and diagnostic compositions containing these antibodies or binding portions thereof, and methods of using these antibodies and binding portions thereof.

The term "antibody" is used in the broadest sense and specifically encompasses monoclonal antibodies (including full length monoclonal antibodies), polyclonal antibodies, multi-specific antibodies (e.g., bispecific antibodies), and antibody fragments so long as they exhibit the desired binding activity, i.e., binding to one or more particular staphylococcal leukotoxins or gamma hemolysins.

In one embodiment, the antibody of the disclosure is an immunoglobulin (Ig) molecule and may comprise four polypeptide chains, e.g., two heavy (H) chains and two light (L) chains linked by disulfide bonds. Five types of mammalian Ig heavy chains are known: α, δ, ε, γ, and μ, wherein the type of heavy chain defines the class (isotype) of the antibody. Antibodies of the disclosure can be of any class (e.g., IgG, IgE, IgM, IgD, IgA and IgY) and subclass (e.g., IgG1, IgG2, IgG3, IgG4, IgA1 and IgA2). The heavy chain(s) may contain one region, i.e., the variable region (VH), or two regions, i.e., the constant region (CH) and the VH. Like the heavy chain, a light chain(s) may also consist of one region, i.e., the variable region (VL), or two regions, i.e., the constant domain (CL) and the VL. In mammals there are two types of immunoglobulin light chain, lambda (λ) and kappa (κ). The subunit structures and three-dimensional configurations of different classes of immunoglobulins are well known in the art. For a review of the antibody structure, see Antibodies: A Laboratory Manual, Cold Spring Harbor Laboratory, eds. Harlow et al., 1988, which is hereby incorporated by reference in its entirety. One of skill in the art will recognize that each subunit structure, e.g., a CH, VH, CL, VL, structure, comprises active fragments. For example, the active portions of the VH and VL are the portions that bind to the antigen, i.e., the antigen-binding fragment. Likewise, the active portion of the CH subunit is the portion that binds to and/or activates an Fc receptor and/or complement. The interaction of the CH subunit with Fc receptors and ligands imparts an array of important effector functions. As described in more detail infra, in some embodiments, the antibodies described herein contain modified or variant Fc regions to enhance or diminish certain effector functions (see e.g., U.S. Pat. No. 8,961,967 to Strohl et al., U.S. Pat. No. 8,871,294 to Brezski et al., U.S. Pat. No. 8,093,357 to Lazar et al., which are hereby incorporated by reference in their entirety The unique binding property or epitope binding specificity of a given antibody is determined by the variable (V) regions. In particular, three variable loops in each of the VL and VH regions, known as complementarity determining regions (CDR), are responsible for the antigen binding specificity.

Typically three CDRs make up the binding character of a light chain variable region (CDRL1, CDRL2 and CDRL3) and three CDRs make up the binding character of a heavy chain variable region (CDRH1, CDRH2 and CDRH3). CDRs contribute to the functional activity of an antibody molecule and are separated by amino acid sequences that comprise scaffolding or framework regions (FR). The exact definitional CDR boundaries and lengths are subject to different classification and numbering systems, e.g., the Kabat system, Chothia system, contact, or any other boundary definitions. Despite differing boundaries, each of these systems has some degree of overlap in what constitutes the so called "hypervariable regions" (i.e., CDRs) within the variable sequences. CDR definitions according to these systems may therefore differ in length and boundary areas with respect to the adjacent framework region. See for example Kabat et al., *Sequences of Proteins of Immunological Interest,* 5th ed. NIH Publication No. 91-3242 (1991); Chothia et al., "Canonical Structures For the Hypervariable Regions of Immunoglobulins," *J. Mol. Biol.* 196:901 (1987); and MacCallum et al., "Antibody-Antigen Interactions: Contact Analysis and Binding Site Topography," *J. Mol. Biol.* 262:732 (1996)), each of which is hereby incorporated by reference in its entirety.

The CDRs form a loop structure that can be classified as a canonical structure. The term "canonical structure" refers to the main chain conformation that is adopted by the antigen binding (CDR) loops. From comparative structural studies, it has been found that five of the six antigen binding loops have only a limited repertoire of available conformations. Each canonical structure can be characterized by the torsion angles of the polypeptide backbone. Correspondent loops between antibodies may, therefore, have very similar three dimensional structures, despite high amino acid sequence variability in most parts of the loops (Chothia et al., "Canonical Structures For the Hypervariable Regions of Immunoglobulins," *J Mol. Biol.* 196:901 (1987); Chothia et al., "Conformations of Immunoglobulin Hypervariable Regions," *Nature* 342:877 (1989); Martin and Thornton, "Structural Families in Loops of Homologous Proteins: Automatic Classification, Modelling and Application to Antibodies," *J. Mol. Biol.* 263:800 (1996), each of which is incorporated by reference in its entirety). Furthermore, there is a relationship between the adopted loop structure and the amino acid sequences surrounding it. The conformation of a particular canonical class is determined by the length of the loop and the amino acid residues residing at key positions within the loop, as well as within the conserved framework (i.e., outside of the loop). Assignment to a particular canonical class can therefore be made based on the presence of these key amino acid residues.

The term "framework region" refers to the art-recognized portions of an antibody variable region that exist between the more divergent (i.e., hypervariable) CDRs. Such framework regions are typically referred to as frameworks 1 through 4 (FR1, FR2, FR3, and FR4) and provide a scaffold for the presentation of the six CDRs (three from the heavy chain and three from the light chain) in three dimensional space, to form an antigen-binding surface.

An antibody fragment of the disclosure is a portion or domain of the antibody containing an epitope binding region (e.g., the VH region, the VL region, or a combination of both regions). In one embodiment, the antibody fragment comprises a single-chain polypeptide containing one, two, or three of the CDRs of the light-chain variable domain, and/or one, two, or three of the CDRs of the heavy chain variable region. In another embodiment, the antibody fragment of the disclosure is a single domain antibody (also referred to as a nanobody), e.g., a peptide chain of about 110 amino acids long comprising one heavy chain variable region domain or one light chain variable region domain of a full antibody. In another embodiment, the antibody fragment is a fragment antigen-binding (F(ab)) fragment or a F(ab')2 fragment.

Antibodies and antibody binding fragments of the present disclosure also encompass mutants, variants, or derivatives of the disclosed antibodies or binding fragments thereof which retain the essential epitope binding features of an Ig molecule. For example, the single domain antibodies can be derived from camelid (VHH domains) or cartilaginous fish (V-NAR) variable domains, alone or fused to an Fc domain. In another embodiment, the antibody fragment comprises the heavy chain and light chain variable regions fused together to form a single-chain variable domain antibody (scFv) or a single-chain variable domain with an Fc portion (i.e., a scFv-Fc, e.g., a minibody.). In another embodiment, the antibody fragment is a divalent or bivalent single-chain variable fragment, engineered by linking two scFvs together either in tandem (i.e., tandem scFv), or such that they dimerize to form diabodies. In yet another embodiment, the antibody is a trivalent single chain variable fragment, engineered by linking three scFvs together, either in tandem or in a trimer formation to form triabodies. In another embodiment, the antibody is a tetrabody single chain variable fragment. In another embodiment, the antibody is a "linear antibody" comprising a pair of tandem Fd segments (VH—CH1-VH—CH1) that form a pair of antigen binding regions (see Zapata et al. *Protein Eng.* 8(10):1057-1062 (1995), which is hereby incorporated by reference in its entirety).

Antibody and binding portions thereof disclosed herein can be mono-valent, bivalent, or tri-valent with regard to binding domains, and the binding domains may be mono-specific, bi-specific, or tri-specific in binding specificity by design.

In one embodiment, the antibody or binding portion thereof as described herein is a chimeric antibody. A chimeric antibody is an antibody where one portion of the amino acid sequence of the heavy and/or light chain is homologous to corresponding sequences in an antibody derived from a particular species or belonging to a particular class, while the remaining segment of each chain is homologous to corresponding sequences in another species or class. Typically the variable region of both light and heavy chains mimics the variable regions of antibodies derived from one species of mammals, while the constant portions are homologous to sequences of antibodies derived from another. For example, the variable region can be derived from presently known sources using readily available B-cells or hybridomas from non-human host organisms in combination with constant regions derived from, for example, human cell preparations. Methods of making chimeric antibodies are well known in the art, see e.g., U.S. Pat. No. 4,816,567 to Cabilly; and Morrison et al., "Chimeric human antibody molecules: mouse antigen-binding domains with human constant region domains" *Proc. Natl. Acad. Sci. USA* 81:6851-6855 (1984), which are hereby incorporated by reference in their entirety.

In another embodiment, the antibody or binding portion thereof is a CDR-grafted antibody. A "CDR-grafted antibody" is an antibody which comprises heavy and light chain variable region sequences of one species, where one or more of the CDR regions are replaced with CDR regions of another species. For example, in one embodiment the CDR grafted antibody comprises human or humanized heavy and light chain variable regions, where one or more of the CDRs within these regions is replaced with one or more CDRs from another species, e.g., murine CDRs.

In another embodiment, the antibody or binding portion thereof is a humanized antibody. A humanized antibody is an antibody or a variant, derivative, analog or portion thereof which comprises a framework region having substantially the amino acid sequence of a human antibody and a complementary determining region having substantially the amino acid sequence of a non-human antibody. As used herein, the term "substantially" in the context of a CDR refers to a CDR having an amino acid sequence that is at least 65%, at least 70%, at least 75%, at least 80%, at least 85%, at least 90%, at least 95%, at least 98% or at least 99% identical to the amino acid sequence of a non-human antibody CDR. Likewise, the term "substantially" in the context of a framework region refers to a framework having an amino acid sequence that is at least 65%, at least 70%, at least 75%, at least 80%, at least 85%, at least 90%, at least 95%, at least 98% or at least 99% identical to the amino acid sequence of a human framework. A humanized antibody comprises substantially all of at least one, and typically two, variable domains (Fab, Fab', F(ab')2, Fv) in which all or substantially all of the CDR regions correspond to those of a non-human immunoglobulin (i.e., the donor antibody), and all or substantially all of the framework regions are those of a humanorhumanized immunoglobulin framework sequence (i.e., the acceptor antibody).

Methods of humanizing antibodies are well known in the art, see e.g., Almagro and Fransson, "Humanization of Antibodies," *Frontiers in Bioscience* 13:1619-1633 (2008), U.S. Pat. No. 6,054,297 to Carter et al., U.S. Pat. No. 8,343,489, and U.S. Patent Application Publication No. US20100261620 to Almagro et al., which are hereby incorporated by reference in their entirety. The human or humanized framework sequences can be chosen based on known structure, i.e., a fixed framework sequence, sequence homology to the framework sequences of the donor antibody (e.g., the antibody from which the CDRs are derived), i.e., a best-fit framework sequence, or a combination of both approaches. Regardless of the method chosen to select the human framework sequence, the sequences can be selected from mature framework sequences, germline gene sequences, or consensus framework sequences. Compatible human framework sequences are those that are similar in both length and sequence to the framework sequence of the donor antibody sequence (i.e., the antibody from which the CDRs are derived) to ensure proper folding of the antibody and binding domain formation.

Humanized antibodies or binding fragments thereof as described herein may comprise the light chain as well as at least the variable domain of a heavy chain. The humanized antibody may further comprise at least a portion of an immunoglobulin constant region (Fc), typically that of a human immunoglobulin. For example, the humanized antibody comprises the CH1, hinge, CH2, CH3, and CH4 regions of a human heavy chain. In another embodiment, the humanized antibody comprises only a humanized light chain. In another embodiment, the humanized antibody comprises only a humanized heavy chain. In another embodiment, the humanized antibody comprises only a humanized variable domain of a light chain and/or a humanized variable domain of a heavy chain.

The antibodies and binding portions thereof described herein can be human antibodies, humanized antibodies (fully or partially humanized), or animal antibodies such as, but not limited to, bird (for example, a duck or a goose), shark, whale, or mammal, including a non-primates (for example, cow, pig, camel, llama, horse, goat, rabbit, sheep, hamster, guinea pig, cat, dog, rat, mouse, etc.) or non-human primates (for example, a monkey, a chimpanzee, etc.).

Antibody "specificity" refers to selective recognition of the antibody or binding portion thereof as described herein for a particular epitope of an leukotoxin or gamma hemolysin toxin. The term "epitope" includes any protein determinant capable of specific binding to an immunoglobulin or T-cell receptor or otherwise interacting with a molecule. Epitopic determinants generally consist of chemically active surface groupings of molecules such as amino acids or carbohydrate or sugar side chains and generally have specific three dimensional structural characteristics, as well as specific charge characteristics. An epitope may be "linear" or "conformational". In a linear epitope, all of the points of interaction between the protein and the antibody occur linearly along the primary amino acid sequence of the protein. In a conformational epitope, the points of interaction occur across amino acid residues on the protein that are separated from one another, i.e., noncontiguous amino acids juxtaposed by tertiary folding of a protein. Epitopes formed from contiguous amino acids are typically retained on exposure to denaturing solvents, whereas epitopes formed by tertiary folding are typically lost on treatment with denaturing solvents. An epitope typically includes at least 3, and more usually, at least 5, 6, 7, 8, 9, 10, 11, 12, 13, 14, 15, 16, 17, 18, 19, 20 or more amino acids in a unique spatial conformation. Antibodies that recognize the same epitope can be verified in a simple immunoassay showing the ability of one antibody to block the binding of another antibody to a target antigen.

The antibodies and binding portions thereof described herein may be neutralizing antibodies or binding portions thereof. In the context of the present disclosure, a neutralizing antibody is an antibody or binding portion thereof that prevents or inhibits the cytolytic activity exhibited by a particular staphylococcal bi-component toxin, e.g., LukAB, LukED, HlgAB, or HlgBC. Neutralization activity of a particular antibody can be assessed using the methods described herein or other methods known and used in the art.

In one embodiment, neutralization activity is assessed by measuring an antibody's capacity to decrease, prevent or inhibit cellular lactate dehydrogenase (LDH) release caused by leukotoxin or hemolysin mediated cellular pore-formation. In another embodiment, neutralization activity is assessed by measuring an antibody's capacity to decrease, prevent, or inhibit bi-component leukotoxin or hemolysin induced cell death.

One aspect of the present disclosure relates to antibodies or binding portions thereof that bind *Staphylococcus aureus* Leukocidin AB (LukAB). LukAB in one of several bi-component, pore-forming toxins produced and secreted by *S. aureus*. These toxins are secreted as water soluble monomers which oligomerize, and insert pores into the plasma membrane of host cells. In one embodiment, LukAB antibodies or binding portions thereof as described herein bind a LukA protein having the amino acid sequence of SEQ ID NO: 829 (Table 25) (which corresponds to the native LukA amino acid sequence containing a poly-histidine tag at the N-terminus to facilitate purification), native LukA, or fragments and homologs thereof, and/or a LukB protein having the amino acid sequence of SEQ ID NO: 830 (Table 25) (which corresponds to the native LukB amino acid sequence containing a poly-histidine tag at the N-terminus to facilitate purification), native LukB, or fragments or homologs thereof. The LukAB antibody or binding portion thereof binds LukA, LukB, and/or LukAB with a Kd of less than or equal to about $10^{-6}$, $10^{-7}$, $10^{-8}$, $10^{-9}$, $10^{-10}$, $10^{-11}$ or $10^{-12}$ M. In one embodiment, the LukAB antibody is a neutralizing antibody, i.e., it neutralizes the cytolytic activity (i.e., pore formation and cell lysis) that LukAB exerts on its target immune host cells. Neutralizing LukAB antibodies neutralize LukAB cytolytic activity by binding to an epitope within regions of the LukA and LukB proteins involved in LukA and LukB protein-protein interaction or involved in LukAB binding to its cognitive receptor on target immune cells (e.g., CD11b).

The LukAB antibody or binding portion thereof as described herein comprises a heavy chain variable region that comprises: a complementarity-determining region 1 (CDR-H1) comprising an amino acid sequence of any one of SEQ ID NOs: 1-20, or a modified amino acid sequence of any one of SEQ ID NOs: 1-20, said modified sequence having at least 80% sequence identity to any one of SEQ ID NOs: 1-20; a complementarity-determining region 2 (CDR-H2) comprising an amino acid sequence of any one of SEQ ID NOs: 21-41, or a modified amino acid sequence of any one of SEQ ID NOs: 21-41, said modified sequences having at least 80% sequence identity to any one of SEQ ID NOs: 21-41; and a complementarity-determining region 3 (CDR-H3) comprising an amino acid sequence of any one of SEQ ID NOs: 42-62 or a modified amino acid sequence of any one of SEQ ID NO:42-62, said modified sequence having at least 80% sequence identity to any one of SEQ ID NOs: 42-62. As described herein, a plurality of LukAB antibodies have been generated and characterized, and the amino acid sequences of the CDR H1, H2 and H3 regions of these LukAB antibodies are provided in Table 1 below.

TABLE 1

LukAB Antibody Heavy Chain CDRs

| mAb/Fab name | VH name | HCDR1 Sequence | SEQ ID NO: | HCDR2 Sequence | SEQ ID NO: | HCDR3 Sequence | SEQ ID NO: |
|---|---|---|---|---|---|---|---|
| SM1B105 | SM1H100 | GYTFSTF | 001 | LPGSGS | 021 | GGYDGMD | 042 |
| SM1B106 | SM1H101 | GYTFSTF | 001 | LPGSGS | 021 | GGYDGMD | 042 |
| SM1B107 | SM1H102 | GYTFSTF | 001 | LPGSGS | 021 | GGYDGMD | 042 |
| SM1B108 | SM1H103 | GYAFSSS | 002 | YPGDGD | 022 | RNYDGYHYGMD | 043 |
| SM1B109 | SM1H100 | GYTFSTF | 001 | LPGSGS | 021 | GGYDGMD | 042 |
| SM1B110 | SM1H104 | GYTFTSY | 003 | DPSDSY | 023 | AAYDNSYYFD | 044 |
| SM1B111 | SM1H106 | GYAFSSS | 002 | YPGDGD | 022 | YGYDYDGEYYYAMD | 045 |
| SM1B112 | SM1H105 | GYTFTNY | 004 | KSYTGE | 024 | GSLFGLD | 046 |
| SM1B243 | HLGH31 | GFNIKDY | 005 | DPANGN | 025 | GDYVPGYFD | 047 |
| SM1B244 | HLGH32 | GDSITSD | 006 | SYSGS | 026 | DYGSPYAMD | 048 |
| SM1B245 | HLGH33 | GYTFSTY | 007 | NPNTGY | 027 | GGSKAFPYYAMD | 049 |
| SM1B246 | HLGH34 | GYSFTGY | 008 | DPYNGA | 028 | GLYGDYWYA | 050 |
| SM1B247 | HLGH35 | GFTFSDY | 009 | SDGGSY | 029 | GPTYYGLD | 051 |
| SM1B248 | HLGH36 | GYSFTSY | 010 | HPSDSE | 030 | LYVDFFD | 052 |
| SM1B249 | HLGH37 | GFTFSSY | 011 | NSNGGS | 031 | PDYPYAMD | 053 |
| SM1B250 | HLGH38 | GYTFTNY | 012 | NTYTGE | 032 | SPSYGSRGAWFA | 054 |
| SM1B251 | HLGH39 | GYTFTNY | 012 | NTYTGE | 032 | SPSYGSRGAWFA | 054 |
| SM1B252 | HLGH40 | GYTFSDY | 013 | LPGSDK | 033 | AGDDYV | 055 |
| SM1B253 | HLGH41 | GFNIKDT | 014 | DPANDI | 034 | DWAD | 056 |
| SM1B254 | HLGH42 | GFNIKDT | 014 | NPANDN | 035 | DWAD | 056 |
| SM1B255 | HLGH43 | GYTFTRY | 015 | NPNNGH | 036 | LDGHLYAVD | 057 |
| SM1B256 | HLGH44 | GYTFTTY | 016 | NPSNDG | 037 | SYYGYGDFD | 058 |
| SM1B257 | HLGH45 | GFSLTSY | 017 | GWNDK | 038 | DGDSSGSWFA | 059 |
| SM1B258 | HLGH46 | GFSLTGY | 018 | GWDDK | 039 | DHGDGGFA | 060 |
| SM1B259 | HLGH47 | GYTFTDY | 019 | NPNNGG | 040 | ENSGYGGNYFA | 061 |
| SM1B260 | HLGH30 | GFNIKDS | 020 | DPEDGE | 041 | SFGV | 062 |
| SM1B261 | HLGH30 | GFNIKDS | 020 | DPEDGE | 041 | SFGV | 062 |
| SM1B262 | HLGH30 | GFNIKDS | 020 | DPEDGE | 041 | SFGV | 062 |
| SM1B263 | HLGH30 | GFNIKDS | 020 | DPEDGE | 041 | SFGV | 062 |
| SM1B264 | HLGH30 | GFNIKDS | 020 | DPEDGE | 041 | SFGV | 062 |
| SM1B265 | HLGH30 | GFNIKDS | 020 | DPEDGE | 041 | SFGV | 062 |
| SM1B266 | HLGH30 | GFNIKDS | 020 | DPEDGE | 041 | SFGV | 062 |
| SM1B267 | HLGH30 | GFNIKDS | 020 | DPEDGE | 041 | SFGV | 062 |
| SM1B268 | HLGH30 | GFNIKDS | 020 | DPEDGE | 041 | SFGV | 062 |
| SM1B269 | HLGH30 | GFNIKDS | 020 | DPEDGE | 041 | SFGV | 062 |
| SM1B270 | HLGH30 | GFNIKDS | 020 | DPEDGE | 041 | SFGV | 062 |

TABLE 1-continued

LukAB Antibody Heavy Chain CDRs

| mAb/Fab name | VH name | HCDR1 Sequence | SEQ ID NO: | HCDR2 Sequence | SEQ ID NO: | HCDR3 Sequence | SEQ ID NO: |
|---|---|---|---|---|---|---|---|
| SM1B271 | HLGH30 | GFNIKDS | 020 | DPEDGE | 041 | SFGV | 062 |
| SM1B272 | HLGH30 | GFNIKDS | 020 | DPEDGE | 041 | SFGV | 062 |
| SM1B273 | HLGH30 | GFNIKDS | 020 | DPEDGE | 041 | SFGV | 062 |
| SM1B274 | HLGH30 | GFNIKDS | 020 | DPEDGE | 041 | SFGV | 062 |
| SM1B275 | HLGH30 | GFNIKDS | 020 | DPEDGE | 041 | SFGV | 062 |

In another embodiment of the present disclosure, the LukAB antibody or binding portion further comprises a light chain variable region. The light chain variable region of the LukAB antibody or binding portion thereof comprises a complementarity-determining region 1 (CDR-L1) having an amino acid sequence of any one of SEQ ID NOs: 63-87, or a modified amino acid sequence of any one of SEQ ID NO: 63-87, said modified sequence having at least 80 sequence identity to any one of SEQ ID NO: 63-87; a complementarity-determining region 2 (CDR-L2) having an amino acid sequence of any one of SEQ ID NOs: 88-105, or a modified amino acids sequence of any one of SEQ ID NO:88-105, said modified sequence having at least 80% sequence identity to any one of SEQ ID NO: 88-105; and a complementarity-determining region (CDR-L3) having an amino acid sequence of anyone of SEQ D NOs: 106-135, or modified amino acid sequence of any one of SEQ ID NO:106-135, said modified sequence having at least 80% sequence identity to any one of SEQ ID NO:106-135. The LukAB antibody CDR-L1, -L2 and -L3 amino acid sequences are provided in Table 2 below.

TABLE 2

LukAB Antibody Light Chain CDRs

| mAb/Fab name | VL name | LCDR1 Sequence | SEQ ID NO: | LCDR2 Sequence | SEQ ID NO: | LCDR3 Sequence | SEQ ID NO: |
|---|---|---|---|---|---|---|---|
| SM1B105 | SM1L19 | SSSVSSSY | 063 | RTS | 088 | WSGYPF | 106 |
| SM1B106 | SM1L20 | SESVDNSGISF | 064 | AAS | 089 | SKEVPY | 107 |
| SM1B107 | SM1L21 | SESVDNSGISF | 064 | AAS | 089 | SKEVPY | 107 |
| SM1B108 | SM1L22 | SQSVSDD | 065 | YAS | 090 | DYSSPW | 108 |
| SM1B109 | SM1L20 | SESVDNSGISF | 064 | AAS | 089 | SKEVPY | 107 |
| SM1B110 | SM1L23 | SSSVSY | 066 | STS | 091 | RSSYPF | 109 |
| SM1B111 | SM1L25 | HSNLISNY | 067 | RTS | 088 | GSSIPF | 110 |
| SM1B112 | SM1L24 | SSHVSY | 068 | DTS | 092 | YSGYPY | 111 |
| SM1B243 | HLGL29 | SQDINSY | 069 | RAN | 093 | YDEFPY | 112 |
| SM1B244 | HLGL30 | SQNVGTN | 070 | SAS | 094 | YNSYPF | 113 |
| SM1B245 | HLGL31 | SESVDGYGNSF | 071 | RAS | 095 | SNGDPF | 114 |
| SM1B246 | HLGL32 | SQSIVHSNGKTY | 072 | KVS | 096 | GSHVPW | 115 |
| SM1B247 | DARL6 | SKSVSISGYSY | 073 | LAS | 097 | SRELPF | 116 |
| SM1B248 | HLGL31 | SESVDGYGNSF | 071 | RAS | 095 | SNGDPF | 114 |
| SM1B249 | HLGL33 | SSSVSY | 066 | DTS | 092 | WISNPP | 117 |
| SM1B250 | HLGL34 | SQSVDYDGDSY | 074 | AAS | 089 | SNEDPL | 118 |
| SM1B251 | HLGL35 | SENIYSY | 075 | NAK | 098 | HYGSPY | 119 |
| SM1B252 | HLGL36 | SQSIVYSNGNTY | 076 | KVS | 096 | GSHVPF | 120 |
| SM1B253 | HLGL37 | SQSLLHSDGKTY | 077 | LVS | 099 | GTHFPY | 121 |

TABLE 2-continued

LukAB Antibody Light Chain CDRs

| mAb/Fab name | VL name | LCDR1 Sequence | SEQ ID NO: | LCDR2 Sequence | SEQ ID NO: | LCDR3 Sequence | SEQ ID NO: |
|---|---|---|---|---|---|---|---|
| SM1B254 | HLGL38 | SQSLLHSDGKTY | 077 | LVS | 099 | GTHFPY | 121 |
| SM1B255 | HLGL39 | SQSLLDSDGETY | 078 | MVS | 100 | GTHFPQ | 122 |
| SM1B256 | HLGL40 | SQSLLDSDGETY | 078 | LVS | 099 | GTHSPY | 123 |
| SM1B257 | HLGL41 | SQDINKY | 079 | YTS | 101 | YDNLR | 124 |
| SM1B258 | HLGL42 | SQSIVHSNGNTY | 080 | KVS | 096 | GSHVPF | 120 |
| SM1B259 | HLGL43 | SSSVSY | 066 | DTS | 092 | WSSYPP | 125 |
| SM1B260 | HLGL31 | SESVDGYGNSF | 071 | RAS | 095 | SNGDPF | 114 |
| SM1B261 | HLGL44 | SENVGTY | 081 | GAS | 102 | SYSYPL | 126 |
| SM1B262 | ATCL189 | SQDINSY | 069 | RAN | 093 | YDEFPL | 127 |
| SM1B263 | HLGL45 | SQDINKY | 079 | YTS | 101 | YDNLW | 128 |
| SM1B264 | HLGL46 | SENIYSN | 082 | AAT | 103 | FWGTPW | 129 |
| SM1B265 | HLGL47 | SENIYSY | 075 | NAK | 098 | HYGSPY | 119 |
| SM1B266 | HLGL48 | SQNINVW | 083 | KAS | 104 | GQSYPL | 130 |
| SM1B267 | HLGL49 | SQNINVW | 083 | KAS | 104 | GQSYPY | 130 |
| SM1B268 | GC5L32 | SSSISSNY | 084 | RTS | 088 | GSSIPR | 131 |
| SM1B269 | C27L19 | SQSVDYDGDSY | 074 | AAS | 089 | SNEDPY | 132 |
| SM1B270 | HLGL50 | SQSVDYDGDSY | 074 | AAS | 089 | SYEDPF | 133 |
| SM1B271 | HLGL43 | SSSVSY | 066 | DTS | 092 | WSSYPP | 125 |
| SM1B272 | IFWL448 | SQNVGTN | 070 | SAS | 094 | YNSYPF | 113 |
| SM1B273 | HLGL51 | SQSLLYSSNQKNY | 085 | WAS | 105 | YYSYPY | 134 |
| SM1B274 | HLGL52 | SQSLVHSNGNTY | 086 | KVS | 096 | STHVPPY | 135 |
| SM1B275 | HLGL53 | SQSLLYSNGKTY | 087 | LVS | 099 | GTHFPQ | 122 |

The LukAB antibodies disclosed herein comprise the heavy chain CDRs of Table 1 and light chain CDRs of Table 2 or modified CDRs thereof. Encompassed by the present disclosure are CDRs of Table 1 and 2 containing 1, 2, 3, 4, 5, or more amino acid substitutions (depending on the length of the CDR) that maintain or enhance LukAB binding of the antibody. The resulting modified CDRs are at least 70%, at least 75%, at least 80%, at least 85%, at least 90%, at least 95% similar in sequence to the CDRs of Tables 1 and 2. Suitable amino acid modifications to the heavy chain CDR sequences of Table 1 and/or the light chain CDR sequences of Table 2 include, for example, conservative substitutions or functionally equivalent amino acid residue substitutions that result in variant CDR sequences having similar or enhanced binding characteristics to those of the CDR sequences of Table 1 and Table 2. Conservative substitutions are those that take place within a family of amino acids that are related in their side chains. Genetically encoded amino acids can be divided into four families: (1) acidic (aspartate, glutamate); (2) basic (lysine, arginine, histidine); (3) non-polar (alanine, valine, leucine, isoleucine, proline, phenylalanine, methionine, tryptophan); and (4) uncharged polar (glycine, asparagine, glutamine, cysteine, serine, threonine, tyrosine). Phenylalanine, tryptophan, and tyrosine are sometimes classified jointly as aromatic amino acids. Alternatively, the amino acid repertoire can be grouped as (1) acidic (aspartate, glutamate); (2) basic (lysine, arginine histidine), (3) aliphatic (glycine, alanine, valine, leucine, isoleucine, serine, threonine), with serine and threonine optionally grouped separately as aliphatic-hydroxyl; (4) aromatic (phenylalanine, tyrosine, tryptophan); (5) amide (asparagine, glutamine); and (6) sulfur-containing (cysteine and methionine) (Stryer (ed.), Biochemistry, 2nd ed, WH Freeman and Co., 1981, which is hereby incorporated by reference in its entirety). Non-conservative substitutions can also be made to the heavy chain CDR sequences of Table 1 and the light chain CDR sequences of Table 2. Non-conservative substitutions involve substituting one or more amino acid residues of the CDR with one or more amino acid residues from a different class of amino acids to improve or enhance the binding properties of CDR. The amino acid sequences of the heavy chain variable region CDRs of Table 1 and/or the light chain variable region CDRs of Table 2 may further comprise one or more internal neutral amino acid insertions or deletions that maintain or enhance LukAB binding.

In one embodiment, the LukAB antibody or binding portion thereof, comprises a heavy chain variable region comprising the CDR-H1 of SEQ ID NO: 1, the CDR-H2 of SEQ ID NO: 21, and the CDR-H3 of SEQ ID NO: 42. In another embodiment, the LukAB antibody or binding portion thereof comprises a heavy chain variable region comprising the CDR-H1 of SEQ ID NO: 2, the CDR-H2 of SEQ ID NO: 22, and the CDR-H3 of SEQ ID NO: 43. In another embodiment, the LukAB antibody of binding portion thereof comprises a heavy chain variable region comprising the CDR-H1 of SEQ ID NO: 2, the CDR-H2 of SEQ ID NO: 22, and the CDR-H3 of SEQ ID NO: 45. In another embodiment, the LukAB antibody of binding portion thereof comprises a heavy chain variable region comprising the CDR-H1 of SEQ ID NO: 3, the CDR-H2 of SEQ ID NO: 23, and the CDR-H3 of SEQ ID NO: 44. In another embodiment, the LukAB antibody or binding portion thereof comprises a heavy chain variable region comprising the CDR-H1 of SEQ ID NO: 4, the CDR-H2 of SEQ ID NO: 24, and the CDR-H3 of SEQ ID NO: 46. In another embodiment, the LukAB antibody or binding portion thereof comprises a heavy chain variable region comprising the CDR-H1 of SEQ ID NO: 5, the CDR-H2 of SEQ ID NO: 25, and the CDR-H3 of SEQ ID NO: 47. In another embodiment, the LukAB antibody or binding portion thereof comprises a heavy chain variable region comprising the CDR-H1 of SEQ ID NO: 6, the CDR-H2 of SEQ ID NO: 26, and the CDR-H3 of SEQ ID NO: 48. In another embodiment, the LukAB antibody of binding portion thereof comprises a heavy chain variable region comprising the CDR-H1 of SEQ ID NO: 7, the CDR-H2 of SEQ ID NO: 27, and the CDR-H3 of SEQ ID NO: 49. In another embodiment, the LukAB antibody of binding portion thereof comprises a heavy chain variable region comprising the CDR-H1 of SEQ ID NO: 8, the CDR-H2 of SEQ ID NO: 28, and the CDR-H3 of SEQ ID NO: 50. In another embodiment, the LukAB antibody of binding portion thereof comprises a heavy chain variable region comprising the CDR-H1 of SEQ ID NO:9, the CDR-H2 of SEQ ID NO: 29, and the CDR-H3 of SEQ ID NO: 51. In another embodiment, the LukAB antibody or binding portion thereof comprises a heavy chain variable region comprising the CDR-H1 of SEQ ID NO: 10, the CDR-H2 of SEQ ID NO: 30, and the CDR-H3 of SEQ ID NO: 52. In another embodiment, the LukAB antibody or binding portion thereof comprises a heavy chain variable region comprising the CDR-H1 of SEQ ID NO: 11, the CDR-H2 of SEQ ID NO: 31, and the CDR-H3 of SEQ ID NO: 53. In another embodiment, the LukAB antibody or binding portion thereof comprises a heavy chain variable region comprising the CDR-H1 of SEQ ID NO: 12, the CDR-H2 of SEQ ID NO: 32, and the CDR-H3 of SEQ ID NO: 54. In another embodiment, the LukAB antibody or binding portion thereof comprises a heavy chain variable region comprising the CDR-H1 of SEQ ID NO: 13, the CDR-H2 of SEQ ID NO: 33, and the CDR-H3 of SEQ ID NO: 55. In another embodiment, the LukAB antibody of binding portion thereof comprises a heavy chain variable region comprising the CDR-H1 of SEQ ID NO: 14, the CDR-H2 of SEQ ID NO: 34, and the CDR-H3 of SEQ ID NO: 56. In another embodiment, the LukAB antibody of binding portion thereof comprises a heavy chain variable region comprising the CDR-H1 of SEQ ID NO: 14, the CDR-H2 of SEQ ID NO: 35, and the CDR-H3 of SEQ ID NO: 56. In another embodiment, the LukAB antibody or binding portion thereof comprises a heavy chain variable region comprising the CDR-H1 of SEQ ID NO: 15, the CDR-H2 of SEQ ID NO: 36, and the CDR-H3 of SEQ ID NO: 57. In another embodiment, the LukAB antibody of binding portion thereof comprises a heavy chain variable region comprising the CDR-H1 of SEQ ID NO: 16, the CDR-H2 of SEQ ID NO: 37, and the CDR-H3 of SEQ ID NO: 58. In another embodiment, the LukAB antibody of binding portion thereof comprises a heavy chain variable region comprising the CDR-H1 of SEQ ID NO: 17, the CDR-H2 of SEQ ID NO: 38, and the CDR-H3 of SEQ ID NO: 59. In another embodiment, the LukAB antibody of binding portion thereof comprises a heavy chain variable region comprising the CDR-H1 of SEQ ID NO: 18, the CDR-H2 of SEQ ID NO:39, and the CDR-H3 of SEQ ID NO: 60. In another embodiment, the LukAB antibody or binding portion thereof comprises a heavy chain variable region comprising the CDR-H1 of SEQ ID NO: 19, the CDR-H2 of SEQ ID NO: 40, and the CDR-H3 of SEQ ID NO: 61. In another embodiment, the LukAB antibody of binding portion thereof comprises a heavy chain variable region comprising the CDR-H1 of SEQ ID NO: 20, the CDR-H2 of SEQ ID NO: 41, and the CDR-H3 of SEQ ID NO: 62.

In one embodiment, the LukAB antibody or binding portion thereof comprises a light chain variable region comprising the CDR-L1 of SEQ ID NO: 63, the CDR-L2 of SEQ ID NO: 88, and the CDR-L3 of SEQ ID NO: 106. In another embodiment, the LukAB antibody or binding portion thereof comprises a light chain variable region comprising the CDR-L1 of SEQ ID NO: 64, the CDR-L2 of SEQ ID NO: 89, and the CDR-L3 of SEQ ID NO: 107. In another embodiment, the LukAB antibody or binding portion thereof comprises a light chain variable region comprising the CDR-L1 of SEQ ID NO: 65, the CDR-L2 of SEQ ID NO: 90, and the CDR-L3 of SEQ ID NO: 108. In another embodiment, the LukAB antibody or binding portion thereof comprises a light chain variable region comprising the CDR-L1 of SEQ ID NO: 66, the CDR-L2 of SEQ ID NO: 91, and the CDR-L3 of SEQ ID NO: 109. In another embodiment, the LukAB antibody or binding portion thereof comprises a light chain variable region comprising the CDR-L1 of SEQ ID NO: 67, the CDR-L2 of SEQ ID NO: 88, and the CDR-L3 of SEQ ID NO: 110. In another embodiment, the LukAB antibody or binding portion thereof comprises a light chain variable region comprising the CDR-L1 of SEQ ID NO: 68, the CDR-L2 of SEQ ID NO: 92, and the CDR-L3 of SEQ ID NO: 111. In another embodiment, the LukAB antibody or binding portion thereof comprises a light chain variable region comprising the CDR-L1 of SEQ ID NO: 69, the CDR-L2 of SEQ ID NO: 93, and the CDR-L3 of SEQ ID NO: 112. In another embodiment, the LukAB antibody or binding portion thereof comprises a light chain variable region comprising the CDR-L1 of SEQ ID NO: 70, the CDR-L2 of SEQ ID NO: 94, and the CDR-L3 of SEQ ID NO: 113. In another embodiment, the LukAB antibody or binding portion thereof comprises a light chain variable region comprising the CDR-L1 of SEQ ID NO: 71, the CDR-L2 of SEQ ID NO: 95, and the CDR-L3 of SEQ ID NO: 114. In another embodiment, the LukAB antibody or binding portion thereof comprises a light chain variable region comprising the CDR-L1 of SEQ ID NO: 72, the CDR-L2 of SEQ ID NO: 96, and the CDR-L3 of SEQ ID NO: 115. In another embodiment, the LukAB antibody or binding portion thereof comprises a light chain variable region comprising the CDR-L1 of SEQ ID NO: 73, the CDR-L2 of SEQ ID NO: 97, and the CDR-L3 of SEQ ID NO: 116. In another embodiment, the LukAB antibody or binding portion thereof comprises a light chain variable region comprising the CDR-L1 of SEQ ID NO: 66, the CDR-L2 of SEQ ID NO: 92, and the CDR-L3 of SEQ ID NO: 117. In another embodiment, the LukAB antibody or binding portion thereof comprises a light chain variable region comprising the CDR-L1 of SEQ ID NO: 74, the CDR-L2 of SEQ ID NO: 89, and the CDR-L3 of SEQ ID NO: 118. In another embodiment, the LukAB antibody or binding portion thereof comprises a light chain variable region comprising the CDR-L1 of SEQ ID NO: 75, the CDR-L2 of SEQ ID NO: 98, and the CDR-L3 of SEQ ID NO: 119. In another embodiment, the LukAB antibody or binding portion thereof comprises a light chain variable region comprising the CDR-L1 of SEQ ID NO: 76, the CDR-L2 of SEQ ID NO: 96, and the CDR-L3 of SEQ ID NO: 120. In another embodiment, the LukAB antibody or binding portion thereof comprises a light chain variable region comprising the CDR-L1 of SEQ ID NO: 77, the CDR-L2 of SEQ ID NO: 99, and the CDR-L3 of SEQ ID NO: 121. In another embodiment, the LukAB antibody or binding portion thereof comprises a light chain variable region comprising the CDR-L1 of SEQ ID NO: 78, the CDR-L2 of SEQ ID NO: 100, and the CDR-L3 of SEQ ID NO: 122. In another embodiment, the LukAB antibody or binding portion thereof comprises a light chain variable region comprising the CDR-L1 of SEQ ID NO: 78, the CDR-L2 of SEQ ID NO: 99, and the CDR-L3 of SEQ ID NO: 123. In another embodiment, the LukAB antibody or binding portion thereof comprises a light chain variable region comprising the CDR-L1 of SEQ ID NO: 79, the CDR-L2 of SEQ ID NO: 101, and the CDR-L3 of SEQ ID NO: 124. In another embodiment, the LukAB antibody or binding portion thereof comprises a light chain variable region comprising the CDR-L1 of SEQ ID NO: 80, the CDR-L2 of SEQ ID NO: 96, and the CDR-L3 of SEQ ID NO: 120. In another embodiment, the LukAB antibody or binding portion thereof comprises a light chain variable region comprising the CDR-L1 of SEQ ID NO: 66, the CDR-L2 of SEQ ID NO: 92, and the CDR-L3 of SEQ ID NO: 125. In another embodiment, the LukAB antibody or binding portion thereof comprises a light chain variable region comprising the CDR-L1 of SEQ ID NO: 71, the CDR-L2 of SEQ ID NO: 95, and the CDR-L3 of SEQ ID NO: 114. In another embodiment, the LukAB antibody or binding portion thereof comprises a light chain variable region comprising the CDR-L1 of SEQ ID NO: 81, the CDR-L2 of SEQ ID NO: 102, and the CDR-L3 of SEQ ID NO: 126. In another embodiment, the LukAB antibody or binding portion thereof comprises a light chain variable region comprising the CDR-L1 of SEQ ID NO: 69, the CDR-L2 of SEQ ID NO: 93, and the CDR-L3 of SEQ ID NO: 127 a light chain variable region comprising the CDR-L1 of SEQ ID NO: 79, the CDR-L2 of SEQ ID NO: 101, and the CDR-L3 of SEQ ID NO: 128. In another embodiment, the LukAB antibody or binding portion thereof comprises a light chain variable region comprising the CDR-L1 of SEQ ID NO: 82, the CDR-L2 of SEQ ID NO: 103, and the CDR-L3 of SEQ ID NO: 129. In another embodiment, the LukAB antibody or binding portion thereof comprises a light chain variable region comprising the CDR-L1 of SEQ ID NO: 75, the CDR-L2 of SEQ ID NO: 98, and the CDR-L3 of SEQ ID NO: 119. In another embodiment, the LukAB antibody or binding portion thereof comprises a light chain variable region comprising the CDR-L1 of SEQ ID NO: 83, the CDR-L2 of SEQ ID NO: 104, and the CDR-L3 of SEQ ID NO: 130. In another embodiment, the LukAB antibody or binding portion thereof comprises a light chain variable region comprising the CDR-L1 of SEQ ID NO: 84, the CDR-L2 of SEQ ID NO: 88, and the CDR-L3 of SEQ ID NO: 131. In another embodiment, the LukAB antibody or binding portion thereof comprises a light chain variable region comprising the CDR-L1 of SEQ ID NO: 74, the CDR-L2 of SEQ ID NO: 89, and the CDR-L3 of SEQ ID NO: 132. In another embodiment, the LukAB antibody or binding portion thereof comprises a light chain variable region comprising the CDR-L1 of SEQ ID NO: 74, the CDR-L2 of SEQ ID NO: 89, and the CDR-L3 of SEQ ID NO: 133. In another embodiment, the LukAB antibody or binding portion thereof comprises a light chain variable region comprising the CDR-L1 of SEQ ID NO: 66, the CDR-L2 of SEQ ID NO: 92, and the CDR-L3 of SEQ ID NO: 125. In another embodiment, the LukAB antibody or binding portion thereof comprises a light chain variable region comprising the CDR-L1 of SEQ ID NO: 70, the CDR-L2 of SEQ ID NO: 94, and the CDR-L3 of SEQ ID NO: 113. In another embodiment, the LukAB antibody or binding portion thereof comprises a light chain variable region comprising the CDR-L1 of SEQ ID NO: 85, the CDR-L2 of SEQ ID NO: 105, and the CDR-L3 of SEQ ID NO: 134. In another embodiment, the LukAB antibody or binding portion thereof comprises a light chain variable region comprising the CDR-L1 of SEQ ID NO: 86, the CDR-L2 of SEQ ID NO: 96, and the CDR-L3 of SEQ ID NO: 135. In another embodiment, the LukAB antibody or binding portion thereof comprises a light chain variable region comprising the CDR-L1 of SEQ ID NO: 87, the CDR-L2 of SEQ ID NO: 99, and the CDR-L3 of SEQ ID NO: 122.

In another embodiment, the LukAB antibody or binding portion thereof comprises the heavy chain CDRs of SEQ ID NOs: 1, 21, and 42 together with the light chain CDRs of SEQ ID NOs: 63, 88, and 106; the heavy chain CDRs of SEQ ID NOs: 1, 21, and 42 together with the light chain CDRs of SEQ ID NOs: 64, 89, and 107; the heavy chain CDRs of SEQ ID NOs: 2, 22, and 43, together with the light chain CDRs of SEQ ID NOs: 65, 90, and 108; the heavy chain CDRs of SEQ ID NOs: 3, 23, and 44 together with the light chain CDRs of SEQ ID NOs: 66, 91, and 109; the heavy chain CDRs of SEQ ID NOs: 2, 22, and 45, together with the light chain CDRs of SEQ ID NOs: 67, 88, and 110; the heavy chain CDRs of SEQ ID NOs:4, 24, and 46 together with the light chain CDRs of SEQ ID NOs: 68, 92, and 111; the heavy chain CDRs of SEQ ID NOs: 5, 25, and 47 together with the light chain CDRs of SEQ ID NOs: 69, 93, and 112; the heavy chain CDRs of SEQ ID NOs: 6, 26, and 48 together with the light chain CDRs of SEQ ID NOs: 70, 94, and 113; the heavy chain CDRs of SEQ ID NOs: 7, 27, and 49 together with the light chain CDRs of SEQ ID NOs: 71, 95, and 114; the heavy chain CDRs of SEQ ID NOs: 8, 28, and 50 together with the light chain CDRs of SEQ ID NOs: 72, 96 and 115; the heavy chain CDRs of SEQ ID NOs: 9, 29, and 51 together with the light chain CDRs of SEQ ID NOs: 73, 97, and 116; the heavy chain CDRs of SEQ ID NOs: 10, 30, and 52 together with the light chain CDRs of SEQ ID NOs: 71, 95 and 114; the heavy chain CDRs of SEQ ID NOs: 11, 31, and 53 together with the light chain CDRs of SEQ ID NOs: 66, 92 and 117; the heavy chain CDRs of SEQ ID NOs: 12, 32, and 54 together with the light chain CDRs of SEQ ID NOs: 74, 89 and 118; the heavy chain CDRs of SEQ ID NOs: 12, 32, and 54 together with the light chain CDRs of SEQ ID NOs: 75, 98 and 119; the heavy chain CDRs of SEQ ID NOs: 13, 33, and 55 together with the light chain CDRs of SEQ ID NOs: 76, 96, and 120; the heavy chain CDRs of SEQ ID NOs: 14, 34, and 56 together with the light chain CDRs of SEQ ID NOs: 77, 99, and 121; the heavy chain CDRs of SEQ ID NOs: 14, 35, and 56 together with the light chain CDRs of SEQ ID NOs: 77, 99, and 121; the heavy chain CDRs of SEQ ID NOs: 15, 36, and 57 together with the light chain CDRs of SEQ ID NOs: 78, 100, and 122; the heavy chain CDRs of SEQ ID NOs: 16, 37, and 58 together with the light chain CDRs of SEQ ID NOs: 78, 99 and 123; the heavy chain CDRs of SEQ ID NOs: 17, 38, and 59 together with the light chain CDRs of SEQ ID NOs: 79, 101 and 124; the heavy chain CDRs of SEQ ID NOs: 18, 39, and 60 together with the light chain CDRs of SEQ ID NOs: 80, 96, and 120; the heavy chain CDRs of SEQ ID NOs: 19, 40, and 61 together with the light chain CDRs of SEQ ID NOs: 66, 92, and 125; the heavy chain CDRs of SEQ ID NOs: 20, 41, and 62 together with the light chain CDRs of SEQ ID NOs: 71, 95 and 114; the heavy chain CDRs of SEQ ID NOs: 20, 41, and 62 together with the light chain CDRs of SEQ ID NOs: 81, 102 and 126; the heavy chain CDRs of SEQ ID NOs: 20, 41, and 62 together with the light chain CDRs of SEQ ID NOs: 69, 93, and 127; the heavy chain CDRs of SEQ ID NOs: 20, 41, and 62 together with the light chain CDRs of SEQ ID NOs: 79, 101, and 128; the heavy chain CDRs of SEQ ID NOs: 20, 41, and 62 together with the light chain CDRs of SEQ ID NOs: 82, 103, and 129; the heavy chain CDRs of SEQ ID NOs: 20, 41, and 62 together with the light chain CDRs of SEQ ID NOs: 75, 98, and 119; the heavy chain CDRs of SEQ ID NOs: 20, 41, and 62 together with the light chain CDRs of SEQ ID NOs: 83, 104, and 130; the heavy chain CDRs of SEQ ID NOs: 20, 41, and 62 together with the light chain CDRs of SEQ ID NOs: 84, 88, and 131; the heavy chain CDRs of SEQ ID NOs: 20, 41, and 62 together with the light chain CDRs of SEQ ID NOs: 74, 89, and 132; the heavy chain CDRs of SEQ ID NOs: 20, 41, and 62 together with the light chain CDRs of SEQ ID NOs: 74, 89, and 133; the heavy chain CDRs of SEQ ID NOs: 20, 41, and 62 together with the light chain CDRs of SEQ ID NOs: 85, 105, and 134; the heavy chain CDRs of SEQ ID NOs: 20, 41, and 62 together with the light chain CDRs of SEQ ID NOs: 86, 96, and 135; the heavy chain CDRs of SEQ ID NOs: 20, 41, and 62 together with the light chain CDRs of SEQ ID NOs: 87, 99 and 122.

The LukAB antibody or binding portion thereof as described herein may comprises a variable light (VL) chain, a variable heavy (VH) chain, or a combination of VL and VH chains. The VL chain of the LukAB antibody comprises an amino acid sequence selected from SEQ ID NOs: 136-176 or an amino acid sequence that is at least 80% identical to any one of the amino acid sequence selected from SEQ ID NOs: 136-176. The VH chain of the LukAB antibody as disclosed herein comprises an amino acid sequence selected from SEQ ID NOs: 177-217 or an amino acid sequence that is at least 80% identical to any one of the amino acid sequence selected from SEQ ID NOs: 177-217. The sequences of the LukAB VL and VH chains are shown in Table 3A below.

TABLE 3A

LukAB Antibody Variable Light (VL) and Variable Heavy (VH) Chain Sequences

| mAb/Fab name | Region | Name | Sequence | SEQ ID NO: |
|---|---|---|---|---|
| SM1B105 | VL | SM1L19 | DIVLTQSPAIMAASLGQKVTMTCSASSSVSSSY LHWYQQKSGASPKPLIHRTSNLASGVPARFSGS GSGTSYSLTISSVEAEDDATYYCQQWSGYPFTF GAGTKLELK | 136 |
| SM1B106 | VL | SM1L20 | DIVMTQSPASLAVSLGQRATISCRASESVDNSGI SFMNWFQQKPGQPPKLLIYAASNQGSGVPARF SGSGSGTDFSLNIHPMEEDDTAMYFCQQSKEVP YTFGGGTKLEIK | 137 |
| SM1B107 | VL | SM1L21 | DIVLTQSPASLAVSLGQRATISCRASESVDNSGI SFMNWFQQKPGQPPKLLIYAASNQGSGVPARF SGSGSGTDFSLNIHPMEEDDTAMYFCQQSKEVP YTFGGGTKLEIK | 138 |
| SM1B108 | VL | SM1L22 | DVVMTQTPKFLLVSAGDRVTITCKASQSVSDD VTWYQQKSGQSPKLLIYYASNRYTGVPDRFTG SGYGTDFTFTISTVQAEDLAVYFCQQDYSSPWT FGGGTKLEIK | 139 |
| SM1B109 | VL | SM1L20 | DIVMTQSPASLAVSLGQRATISCRASESVDNSGI SFMNWFQQKPGQPPKLLIYAASNQGSGVPARF SGSGSGTDFSLNIFIPMEEDDTAMYFCQQSKEVP YTFGGGTKLEIK | 140 |
| SM1B110 | VL | SM1L23 | DIVLTQSPAIMSASPGEKVTITCSASSSVSYMH WFQQKPGTSPKLWIYSTSNLASGVPARFSGSGS GTSYSLTISRMEAEDAATYYCQQRSSYPFTFGS GTKLEIK | 141 |
| SM1B111 | VL | SM1L25 | DIVMTQSPTTMAASPGERITITCSAHSNLISNYL HWYQQKPGFSPKLLIYRTSNLASGVPARFSGSG SGTSYSLTIGTMEAEDVATYFCQQGSSIPFTFGS GTKLEIK | 142 |

TABLE 3A-continued

LukAB Antibody Variable Light (VL) and Variable Heavy (VH) Chain Sequences

| mAb/Fab name | Region Name | Sequence | SEQ ID NO: |
|---|---|---|---|
| SM1B112 VL | SM1L24 | QIVLTQSPTIMSASPGEKVTMTCSASSHVSYIY WYQQKPGSSPRLWIYDTSNLVSGVPARFSGSRS GTSYSLTISSMEAEDAATYYCQQYSGYPYTFGG GTKLEIK | 143 |
| SM1B243 VL | HLGL29 | DIKMTQSPSSMYASLGERVTITCKASQDINSYLS WFQQKPGKSPKTLIYRANRLVDGVPSRFSGSGS GQDYSPTISSLEYEDMGIYYCLQYDEFPYTFGG GTKLEIK | 144 |
| SM1B244 VL | HLGL30 | DIVMTQSQKFMSTSVGDRVSVTCKASQNVGTN VAWYQQKPGQSPKTLIYSASYRYSGVPDSFTGS GSGTDFTLTISNVQSEDWAEYFCQQYNSYPFTF GSGTKLEIK | 145 |
| SM1B245 VL | HLGL31 | DIVLTQSPASLAVSLGQRATMSCRASESVDGYG NSFLHWYQQKPGQPPKLLIYRASNLESGIPARF SGTGSRTDFTLTITPVEADDVATYYCQQSNGDP FTFGSGTKLEIK | 146 |
| SM1B246 VL | HLGL32 | DVLMTQTPLSLPVSLGDQASISCRSSQSIVHSNG KTYLEWYLQKPGQSPKLLIYKVSNRFSGVPDRF SGSGSGTDFTLKISRVEAEDLGVYYCLQGSHVP WTFGGGTKLELK | 147 |
| SM1B247 VL | DARL6 | DIVLTQSPASLAVSLGQRATISCRASKSVSISGY SYMHWYQQKPGQPPKLLIDLASNLESGVPARF SGSGSGTDFTLNIHPVEEEDAATYYCQHSRELP FTFGSGTKLEIK | 148 |
| SM1B248 VL | HLGL31 | DIVLTQSPASLAVSLGQRATMSCRASESVDGYG NSFLHWYQQKPGQPPKLLIYRASNLESGIPARF SGTGSRTDFTLTITPVEADDVATYYCQQSNGDP FTFGSGTKLEIK | 149 |
| SM1B249 VL | HLGL33 | QIVLTQSPAIMSASPGEKVTMTCSASSSVSYMH WYQQKSGTSPKRWIYDTSKLASGVPARFSGSG SGTSYSLTISSMEAEDAATYYCQQWISNPPTFG GGTKLEIK | 150 |
| SM1B250 VL | HLGL34 | DIVLTQSPASLAVSLEQRATISCKASQSVDYDG DSYMNWYQQKPGQPPKLLIYAASNLESGIPARF SGSGSGTDFTLNIHPVEEEDAATYYCQQSNEDP LTFGAGTKLELK | 151 |
| SM1B251 VL | HLGL35 | DIQMTQSPASLSASVGETVTTICRASENIYSYLA WYQQKQGKSPQLLVYNAKTLVEGVPSRFSGSG SGTQFSLKINSLQPEDFGSYYCQHHYGSPYTFG GGTKLELK | 152 |
| SM1B252 VL | HLGL36 | DVLMTQTPLSLPVSLGDQASISCRSSQSIVYSNG NTYLEWYLQKPGQSPKLLIYKVSNRFSGVPDRF SGSGSGTDFTLKISRVEAEDLGVYYCFQGSHVP FTFGSGTKLEIK | 153 |
| SM1B253 VL | HLGL37 | DVVMTQTPLTLSVTIGQAASISCKSSQSLLHSD GKTYLNWLLQRPGQSPKRLIYLVSKLDSGVPD RFTGSGSGTDFTLKISRVEAEDLGVYYCWQGT HFPYTFGGGTKLEIK | 154 |
| SM1B254 VL | HLGL38 | DVVMTQTPLTLSVTVGQPASISCKSSQSLLHSD GKTYLNWLLQRPGQSPKRLIYLVSKLDSGVPD RFTGSGSGTDFTLKISRVEAEDLGVYYCWQGT HFPYTFGGGTKLEIK | 155 |
| SM1B255 VL | HLGL39 | DVVMTQTPLTLSVTIGQPASISCKSSQSLLDSDG ETYLNWLLQRPGQSPKRLIYMVSKLDSGVPDR FTGSGSGTDFTLKISRVEAEDLGVYYCWQGTH FPQTFGGGTKLELK | 156 |
| SM1B256 VL | HLGL40 | DVVMTQTPLTLSVTNGQPASISCKSSQSLLDSD GETYLNWLLQRPGQSPKRLIYLVSKLDSGVPDR | 157 |

TABLE 3A-continued

LukAB Antibody Variable Light (VL) and Variable Heavy (VH) Chain Sequences

| mAb/Fab name | Region | Name | Sequence | SEQ ID NO: |
|---|---|---|---|---|
| | | | FIGSGSGTDFTLKISRVEAEDLGVYFCWQGTHS PYTFGGGTKLEIK | |
| SM1B257 | VL | HLGL41 | DIQMTQSPSSLSASLGGKVTITCKASQDINKYIA WYQHKPGKGPRLLIHYTSTLQPGIPSRFSGSGS GRDYSFSISNLEPEDIATYYCLQYDNLRTFGGG TKVEIK | 158 |
| SM1B258 | VL | HLGL42 | DVLMTQTPLSLPVSLGDQASISCRSSQSIVHSNG NTYLEWYLQKPGQSPKLLIYKVSNRFSGVPDRF SGSGSGTDFTLKISRVEAEDLGVYYCFQGSHVP FTFGSGTKLEIK | 159 |
| SM1B259 | VL | HLGL43 | QIVLTQSPAIMSASPGEKVTMTCSASSSVSYMY WYQQKPGSSPRLLIYDTSNLASGVPVRFSGSGS GTSYSLTISRMEAEDAATYYCQQWSSYPPTFGG GTKLEIK | 160 |
| SM1B260 | VL | HLGL31 | DIVLTQSPASLAVSLGQRATMSCRASESVDGYG NSFLHWYQQKPGQPPKLLIYRASNLESGIPARF SGTGSRTDFTLTITPVEADDVATYYCQQSNGDP FTFGSGTKLEIK | 161 |
| SM1B261 | VL | HLGL44 | NIVMTQSPKSMSMSVGERVTLSCKASENVGTY VSWYQQKPEQSPKLLIYGASNRYTGVPERFTGS GSATDFTLTISSVQAEDLADYHCGQSYSYPLTF GAGTKLELK | 162 |
| SM1B262 | VL | ATCL189 | DIKMTQSPSSMYASLGERVTITCKASQDINSYLS WFQQKPGKSPKTLIYRANRLVDGVPSRFSGSGS GQDYSLTISSLEYEDMGIYYCLQYDEFPLTFGA GTKLELK | 163 |
| SM1B263 | VL | HLGL45 | DIQMTQSPSSLSASLGGKVTITCKASQDINKYIA WYQHKPGKGPRLLIHYTSTLQPGIPSRFSGSGS GRDYSFSISNLEPEDIATYYCLQYDNLWTFGGG TKVEIK | 164 |
| SM1B264 | VL | HLGL46 | DIQMTQSPASLSASVGETVTIICRASENIYSNLA WYQQKQGKSPQLLVYAATNLADGMPSRFSGS GSGTQYSLKINSLQSEDFGSYYCQHFWGTPWT FGGGTKLEIK | 165 |
| SM1B265 | VL | HLGL47 | DIQMTQSPASLSASVGETVTIICRASENIYSYLA WYQQKQGKSPQLLFYNAKTLVEGVPSRFSGSG SGTQFSLKINSLQPEDFGSYYCQHHYGSPYTFG GGTKLELK | 166 |
| SM1B266 | VL | HLGL48 | DIQMTQSPSTLSASLGDTITITCHASQNINVWLS WYQQKPGNIPKLLIYKASNLHTGVPSRFSGSGS GTGFTLTISSLQPEDIATYYCQQGQSYPLTFGAG TKVEIK | 167 |
| SM1B267 | VL | HLGL49 | DIQMTQSPSTLSASLGDTITITCHASQNINVWLS WYQQKPGNIPKLLIYKASNLHTGVPSRFSGSGS GTGFTLTISSLQPEDIATYYCQQGQSYPYTFGG GTKLEIK | 168 |
| SM1B268 | VL | GC5L32 | EIVLTQSPTTMAASPGEKITITCSASSSISSNYLH WYQQKPGFSPKLLIYRTSNLASGVPARFSGSGS GTSYSLTIGTMEAEDVATYYCQQGSSIPRTFGG GTKLEIK | 169 |
| SM1B269 | VL | C27L19 | DIVLTQSPASLAVSLGQRATISCKASQSVDYDG DSYMNWYQQKPGQPPKLLIYAASNLESGIPARF SGSGSGTDFTLNIHPVEEEDAATYYCQQSNEDP YTFGGGTKLEIK | 170 |
| SM1B270 | VL | HLGL50 | DIVLTQSPASLAVSLGQRASISCKASQSVDYDG DSYMNWYQQKPGQPPKLLIYAASNLESGIPARF SGSGSGTDFTLNIHPVEEEDAATYYCQQSYEDP FTFGSGTKLEIK | 171 |

TABLE 3A-continued

LukAB Antibody Variable Light (VL) and Variable Heavy (VH) Chain Sequences

| mAb/Fab name | Region | Name | Sequence | SEQ ID NO: |
|---|---|---|---|---|
| SM1B271 | VL | HLGL43 | QIVLTQSPAIMSASPGEKVTMTCSASSSVSYMY WYQQKPGSSPRLLIYDTSNLASGVPVRFSGSGS GTSYSLTISRMEAEDAATYYCQQWSSYPPTFGG GTKLEIK | 172 |
| SM1B272 | VL | IFWL448 | DIVMTQSQKFMSTSVGDRVSVTCKASQNVGTN VAWYQQKPGQSPKALIYSASYRYSGVPDRFTG SGSGTDFTLTISNVQSEDLAEYFCQQYNSYPFTF GSGTKLEIK | 173 |
| SM1B273 | VL | HLGL51 | DIVMSQSPSSLAVSVGEKVTMSCKSSQSLLYSS NQKNYLAWYQQKPGQSPKLLIYWASTRESGVP DRFTGSGSGTDFTLTISSVKAEDLAVYYCQQYY SYPYTFGGGTKLEIK | 174 |
| SM1B274 | VL | HLGL52 | DVVMTQTPLSLPVSLGDQASISCRSSQSLVHSN GNTYLHWYLQKPGQSPKLLIYKVSNRFSGVPD RFSGSGSGTDFTLKISRVEAEDLGVYFCSQSTH VPPYTFGGGTKLELK | 175 |
| SM1B275 | VL | HLGL53 | DVVMTQTPLTLSVTIGQPASISCKSSQSLLYSNG KTYLNWLLQRPGQSPKRLIYLVSKLDSGVPDRF TGSGSGTDFTLKISRVEAEDLGVYFCVQGTHFP QTFGGGTKLELK | 176 |
| SM1B105 | VH | SM1H100 | EVQLQQSGAELMTPGASVKISCKATGYTFSTF WIEWIKQRPGHGLEWIGEILPGSGSTKYNEKFK GKATFTADTSSNTAYMQLSSLTSEDSAVYYCA RGGYDGMDYWGQGTSVTVSS | 177 |
| SM1B106 | VH | SM1H101 | EVQLQQSGAELMTPGASVKISCKATGYTFSTF WIEWIKQRPGHGLEWIGEILPGSGSTKYNEKFK GKATFTADTSSNTAYMQLSSLSSEDSAVYYCA RGGYDGMDYWGQGTSVTVSS | 178 |
| SM1B107 | VH | SM1H102 | EVQLQQSEAELMTPGASVKISCKATGYTFSTFW IEWIKQRPGHGLEWIGEILPGSGSTKYNEKFKG KATFTADTSSNTAYMQLSSLTSEDSAVYYCAR GGYDGMDYWGQGTSVTVSS | 179 |
| SM1B108 | VH | SM1H103 | EVQLQQSGAELVKPGASVKISCKASGYAFSSS WMNWVKQRPGKGLEWIGRIYPGDGDTNYHG KFKGKATLTADKSSSTAYMQLSSLTSEDSAVYF CARRNYDGYHYGMDYWGQGTSVTVSS | 180 |
| SM1B109 | VH | SM1H100 | EVQLQQSGAELMTPGASVKISCKATGYTFSTF WIEWIKQRPGHGLEWIGEILPGSGSTKYNEKFK GKATFTADTSSNTAYMQLSSLTSEDSAVYYCA RGGYDGMDYWGQGTSVTVSS | 181 |
| SM1B110 | VH | SM1H104 | EVQLQQSGAELVKPGTSVKMSCKASGYTFTSY WMHWVKLRPGQGLEWIGVIDPSDSYTNYNQK FKGRATLTGDTSSSTAYMQLSSLTSEDSAVYYC TRAAYDNSYYFDYWGQGTTLTVSS | 182 |
| SM1B111 | VH | SM1H106 | EVQLQQSGAELVKPGASVKISCKASGYAFSSS WMNWLKQRPGKGLEWIGRIYPGDGDTNYNGK FKGKATLTADKSSSTAYMQLSSLTSEDSAVYFC ARYGYDYDGEYYYAMDYWGQGTSVTVSS | 183 |
| SM1B112 | VH | SM1H105 | QVQLKESGPELKKPGETVRISCKASGYTFTNYG MNWVKQTPGKGLKWIDWLKSYTGEPTHTGDF KGRFDLSLETSANTAYLQINNLKNEDTATYFCA RGSLFGLDYWGQGTSVTVSS | 184 |
| SM1B243 | VH | HLGH31 | EVQLQQSGAELVKSGASVKLSCTASGFNIKDY YMHWVKQRPEQGLEWIGRIDPANGNTKYDPK FQDKATITSDTSSNTAYLQLSSLTSEDTAVYYC AEGDYVPGYFDVWGAGTTVTVSS | 185 |
| SM1B244 | VH | HLGH32 | EVQLQESGPSLVKPSQTLSLTCSVTGDSITSDY WNWIRKFPGNKLEYMGYISYSGSTYYNPSLKS RISITRDTSKNQYYLQLNSVTTEDTATYYCAGD YGSPYAMDYWGQGTSVTVSS | 186 |

TABLE 3A-continued

LukAB Antibody Variable Light (VL) and Variable Heavy (VH) Chain Sequences

| mAb/Fab name | Region | Name | Sequence | SEQ ID NO: |
|---|---|---|---|---|
| SM1B245 | VH | HLGH33 | QVQLQQSGAELAKPGASVKMSCKSSGYTFSTY WMHWVKQRPGQGLEWIGYINPNTGYTEYNQK FKDTATLTADKSSSTAYMQLSSLTSEDSAVYYC ARGGSKAFPYYAMDYWGQGTSVTVSS | 187 |
| SM1B246 | VH | HLGH34 | EIQLQQSGPELVKPGASVKMSCKASGYSFTGY NMHWVKQSHGKSLEWIGYIDPYNGATSHNQK FKGKATLTVEKSSSTAYMQLNSLTSEDSAVYY CARGLYGDWYAYWGQGTLVTVSS | 188 |
| SM1B247 | VH | HLGH35 | EVQLVESGGGLVKPGGSLKLSCAASGFTFSDY YMYWVRQTPEKRLEWVATISDGGSYTFYPDSV KGRFTISRDNAKNNLYLQMSSLKSEDTAMYYC ARGPTYYGLDYWGQGTTLTVSS | 189 |
| SM1B248 | VH | HLGH36 | QVQLQQPGAELVRPGASVRLCKASGYSFTSY WMSWVKVRPGQGLEWIGMIHPSDSETRLNQK FKDKATLTVDKSSSTAYMQLSSPTSEDSAVYY CARLYVDFFDYWGQGTTLTVSS | 190 |
| SM1B249 | VH | HLGH37 | DVKLVESGGGLVKLGGSLKLSCAASGFTFSSY YMSWVRQTPEKRLELVAAINSNGGSTYYPDTV KGRFTISRDNAKNTLYLQMSSLKSEDTALYYC ARPDYPYAMDYWGQGTSVTVSS | 191 |
| SM1B250 | VH | HLGH38 | QIQLVQSGPELKKPGETVKISCKASGYTFTNYG MNWVKQAPGKGLKWMGWINTYTGEPTYADD FKGRFAFSLETSASTAYLQINNLKNEDTATYFC ARSPSYGSRGAWFAYWSQGTLVTVSA | 192 |
| SM1B251 | VH | HLGH39 | QIQLVQSGPELKKPGETVKISCKASGYTFTNYG MNWVKQAPGKGLKWMGWINTYTGEPTYADD FKGRFAFSLETSASTAYLQINNLKNEDTATYFC ARSPSYGSRGAWFAYWGQGTLVTVSA | 193 |
| SM1B252 | VH | HLGH40 | QVQLQQSGAELMKPGASVKISCKASGYTFSDY WIEWIKQRPGHGLEWMGEILPGSDKTNYNEKF KGKATFTADSSSNTAYMQLNSLTSEDSAVFYC ATAGDDYVKWGQGTLVTVSA | 194 |
| SM1B253 | VH | HLGH41 | EVQLQQSGAELVKPGASVKLSCTASGFNIKDTY MHWVRQRPEQGLEWIGRIDPANDITKYDPKFQ GKATITADTSSNTAYLQLSSLTSEDTAVYYCGR DWADYWGQGTTLTVSS | 195 |
| SM1B254 | VH | HLGH42 | EVQLQQSGAELVKPGASVKLSCTASGFNIKDTY MHWVKQRSEQGLEWIGRINPANDNTKYDPKF QGKATITADTSSNTAYLQLSSLTSEDTAVYYCG RDWADYWGQGTTLTVSS | 196 |
| SM1B255 | VH | HLGH43 | QVQLQQPGAELVKPGASVKLSCKASGYTFTRY WMHWVKQRPGQGLEWIGEINPNNGHTNYNEK FESRATLTVDKSSSTAYMQFNSLTSEDSAVYYC GRLDGHLYAVDYWGQGTSVTVSS | 197 |
| SM1B256 | VH | HLGH44 | QVQLQQPGTELKMPGTSVKLSCKASGYTFTTY WMHWVKLRPGQGFEWIGEINPSNDGTNYNEK FKRKATLTVDKPSSTAYMQLSSLTSEDSTIYYC TISYYGYGDFDYWGQGTTLTVSS | 198 |
| SM1B257 | VH | HLGH45 | QVQLKESGPDLVQPSQTLSLTCTVSGFSLTSYG VHWVRQPPGKGLEWVGTMGWNDKKYYNSAL KSRLSISRNTSKNQVFLKLSSLQTEDTAMYYCT RDGDSSGSWFAYWGQGTLVTVSS | 199 |
| SM1B258 | VH | HLGH46 | QVQLKESGPDLVQPSQTLSLTCTVSGFSLTGYA VHWVRQPPGKGVEWVGTMGWDDKKFYNSAL KSRLSISRDPSKNQVFFKLSSLQTEDTAMYYCT RDHGDGGFAYWGQGTLVTVSS | 200 |
| SM1B259 | VH | HLGH47 | EVQLQQSGPELVKPGASVKIPCKASGYTFTDYN MDWVKQSHGKSLEWIGNINPNNGGTIYNQNFK | 201 |

TABLE 3A-continued

LukAB Antibody Variable Light (VL) and Variable Heavy (VH) Chain Sequences

| mAb/Fab name | Region | Name | Sequence | SEQ ID NO: |
|---|---|---|---|---|
| | | | DRATLTVDKSSTAYMELRSLTSEDTAVYYCT RENSGYGGNYFAYWGQGTTLTVSS | |
| SM1B260 | VH | HLGH30 | EVQLQQSGAELVRPGASVKLSCTTSGFNIKDSLI YWVKQRPEQGLEWIGWIDPEDGETKFAPRFQD KATITSDTSSNTAYLRLSSLTSEDTAIYYCTRSF GVCWGQGTLVTVSA | 202 |
| SM1B261 | VH | HLGH30 | EVQLQQSGAELVRPGASVKLSCTTSGFNIKDSLI YWVKQRPEQGLEWIGWIDPEDGETKFAPRFQD KATITSDTSSNTAYLRLSSLTSEDTAIYYCTRSF GVCWGQGTLVTVSA | 203 |
| SM1B262 | VH | HLGH30 | EVQLQQSGAELVRPGASVKLSCTTSGFNIKDSLI YWVKQRPEQGLEWIGWIDPEDGETKFAPRFQD KATITSDTSSNTAYLRLSSLTSEDTAIYYCTRSF GVCWGQGTLVTVSA | 204 |
| SM1B263 | VH | HLGH30 | EVQLQQSGAELVRPGASVKLSCTTSGFNIKDSLI YWVKQRPEQGLEWIGWIDPEDGETKFAPRFQD KATITSDTSSNTAYLRLSSLTSEDTAIYYCTRSF GVCWGQGTLVTVSA | 205 |
| SM1B264 | VH | HLGH30 | EVQLQQSGAELVRPGASVKLSCTTSGFNIKDSLI YWVKQRPEQGLEWIGWIDPEDGETKFAPRFQD KATITSDTSSNTAYLRLSSLTSEDTAIYYCTRSF GVCWGQGTLVTVSA | 206 |
| SM1B265 | VH | HLGH30 | EVQLQQSGAELVRPGASVKLSCTTSGFNIKDSLI YWVKQRPEQGLEWIGWIDPEDGETKFAPRFQD KATITSDTSSNTAYLRLSSLTSEDTAIYYCTRSF GVCWGQGTLVTVSA | 207 |
| SM1B266 | VH | HLGH30 | EVQLQQSGAELVRPGASVKLSCTTSGFNIKDSLI YWVKQRPEQGLEWIGWIDPEDGETKFAPRFQD KATITSDTSSNTAYLRLSSLTSEDTAIYYCTRSF GVCWGQGTLVTVSA | 208 |
| SM1B267 | VH | HLGH30 | EVQLQQSGAELVRPGASVKLSCTTSGFNIKDSLI YWVKQRPEQGLEWIGWIDPEDGETKFAPRFQD KATITSDTSSNTAYLRLSSLTSEDTAIYYCTRSF GVCWGQGTLVTVSA | 209 |
| SM1B268 | VH | HLGH30 | EVQLQQSGAELVRPGASVKLSCTTSGFNIKDSLI YWVKQRPEQGLEWIGWIDPEDGETKFAPRFQD KATITSDTSSNTAYLRLSSLTSEDTAIYYCTRSF GVCWGQGTLVTVSA | 210 |
| SM1B269 | VH | HLGH30 | EVQLQQSGAELVRPGASVKLSCTTSGFNIKDSLI YWVKQRPEQGLEWIGWIDPEDGETKFAPRFQD KATITSDTSSNTAYLRLSSLTSEDTAIYYCTRSF GVCWGQGTLVTVSA | 211 |
| SM1B270 | VH | HLGH30 | EVQLQQSGAELVRPGASVKLSCTTSGFNIKDSLI YWVKQRPEQGLEWIGWIDPEDGETKFAPRFQD KATITSDTSSNTAYLRLSSLTSEDTAIYYCTRSF GVCWGQGTLVTVSA | 212 |
| SM1B271 | VH | HLGH30 | EVQLQQSGAELVRPGASVKLSCTTSGFNIKDSLI YWVKQRPEQGLEWIGWIDPEDGETKFAPRFQD KATITSDTSSNTAYLRLSSLTSEDTAIYYCTRSF GVCWGQGTLVTVSA | 213 |
| SM1B272 | VH | HLGH30 | EVQLQQSGAELVRPGASVKLSCTTSGFNIKDSLI YWVKQRPEQGLEWIGWIDPEDGETKFAPRFQD KATITSDTSSNTAYLRLSSLTSEDTAIYYCTRSF GVCWGQGTLVTVSA | 214 |
| SM1B273 | VH | HLGH30 | EVQLQQSGAELVRPGASVKLSCTTSGFNIKDSLI YWVKQRPEQGLEWIGWIDPEDGETKFAPRFQD KATITSDTSSNTAYLRLSSLTSEDTAIYYCTRSF GVCWGQGTLVTVSA | 215 |

TABLE 3A-continued

LukAB Antibody Variable Light (VL) and Variable Heavy (VH) Chain Sequences

| mAb/Fab name | Region Name | Sequence | SEQ ID NO: |
|---|---|---|---|
| SM1B274 | VH | HLGH30 | EVQLQQSGAELVRPGASVKLSCTTSGFNIKDSLI YWVKQRPEQGLEWIGWIDPEDGETKFAPRFQD KATITSDTSSNTAYLRLSSLTSEDTAIYYCTRSF GVCWGQGTLVTVSA | 216 |
| SM1B275 | VH | HLGH30 | EVQLQQSGAELVRPGASVKLSCTTSGFNIKDSLI YWVKQRPEQGLEWIGWIDPEDGETKFAPRFQD KATITSDTSSNTAYLRLSSLTSEDTAIYYCTRSF GVCWGQGTLVTVSA | 217 |

In another embodiment, the antibody or binding fragment thereof comprises a VH region having an amino acid sequence that shares at least 60%, at least 65%, at least 70%, at least 75%, at least 80%, at least 85%, at least 90%, at least 91%, at least 92%, at least 93%, at least 94% at least 95% at least 96%, at least 97% at least 98%, at least 99% sequence identity to any one of SEQ ID NOs: 177-217 as shown in Table 3A, and/or a VL region having an amino acid sequence that shares at least 60%, at least 65%, at least 70%, at least 75% at least 80%, at least 85%, at least 90%, at least 91%, at least 92%, at least 93% at least 94% at least 95% at least 96%, at least 97% at least 98%, at least 99% sequence identity to any one of SEQ ID NOs: 136-176 as shown in Table 3A.

In one embodiment, the antibody or binding fragment thereof of the present disclosure comprises a humanized VH variant of any one of SEQ ID NOs: 177-217 and/or a humanized VL variant of any one of SEQ ID NOs: 136-176, where the framework regions are humanized or replaced with human immunoglobulin framework sequences. As noted supra, suitable human or humanized framework sequences can be chosen based on their known structure, a consensus sequence, sequence homology to the framework sequences of donor antibody (e.g., the framework sequences of SEQ ID NOs: 136-217), or a combination of these approaches. The humanized framework regions are designed to be similar in length and sequence to the parental framework sequences of SEQ ID NOs: 136-217, respectively. In one embodiment, the humanized framework regions share 50%, 55%, 60%, 65%, 70%, 75%, 80%, 85%, 90%, 95% or more sequence identity to the framework regions of any one of SEQ ID NOs: 136-217, respectively. In another embodiment, the humanized framework regions are 60%, 65%, 70%, 75%, 80%, 85%, 90%, 95% or more similar in length to the framework regions of any one of SEQ ID NOs: 136-217, respectively. Humanized variants of the VH of any one of SEQ ID NOs: 177-217 and the VL of any one of SEQ ID NOs: 136-176 share at least 50%, at least 55%, at least 60%, at least 65%, at least 70%, at least 75%, at least 80%, at least 85%, at least 90%, at least 95% sequence identity along the entire length of SEQ ID NOs: 177-217 and SEQ ID NOs: 136-176, respectively.

Suitable LukAB antibodies or binding portions thereof as disclosed herein comprise a VL of SEQ ID NO: 136 and a VH of SEQ ID NO: 177, a VL of SEQ ID NO: 137 and a VH of SEQ ID NO: 178, a VL of SEQ ID NO: 179, a VL of SEQ ID NO:139 and a VH of SEQ ID NO: 180, a VL of SEQ ID NO: 140 and a VH of SEQ ID NO: 181, a VL of SEQ ID NO: 141 and a VH of SEQ ID NO: 182, a VL of SEQ ID NO: 142 and a VH of SEQ ID NO: 183, a VL of SEQ ID NO: 143 and a VH of SEQ ID NO: 184, a VL of SEQ ID NO: 144 and a VH of SEQ ID NO: 185, a VL of SEQ ID NO: 145 and a VH of SEQ ID NO: 186, a VL of SEQ ID NO: 146 and a VH of SEQ ID NO: 187, a VL of SEQ ID NO: 147 and a VH of SEQ ID NO: 188, a VL of SEQ ID NO: 148 and a VH of SEQ ID NO: 189, a VL of SEQ ID NO: 149 and a VH of SEQ ID NO: 190, a VL of SEQ ID NO: 150 and a VH of SEQ ID NO: 191, a VL of SEQ ID NO: 151 and a VH of SEQ ID NO: 192, a VL of SEQ ID NO: 152 and a VH of SEQ ID NO: 193, a VL of SEQ ID NO: 153 and a VH of SEQ ID NO: 194, a VL of SEQ ID NO: 154 and a VH of SEQ ID NO: 195, a VL of SEQ ID NO: 155 and a VH of SEQ ID NO: 196, a VL of SEQ ID NO: 156 and a VH of SEQ ID NO: 197, a VL of SEQ ID NO: 157 and a VH of SEQ ID NO: 198, a VL of SEQ ID NO: 158 and a VH of SEQ ID NO: 199, a VL of SEQ ID NO: 159 and a VH of SEQ ID NO: 200, a VL of SEQ ID NO: 160 and a VH of SEQ ID NO: 201, a VL of SEQ ID NO: 161 and a VH of SEQ ID NO: 202, a VL of SEQ ID NO: 162 and a VH of SEQ ID NO: 203, a VL of SEQ ID NO: 163 and a VH of SEQ ID NO: 204, a VL of SEQ ID NO: 164 and a VH of SEQ ID NO: 205, a VL of SEQ ID NO: 165 and a VH of SEQ ID NO: 206, a VL of SEQ ID NO: 166 and a VH of SEQ ID NO: 207, a VL of SEQ ID NO: 167 and a VH of SEQ ID NO: 208, a VL of SEQ ID NO: 168 and a VH of SEQ ID NO: 209, a VL of SEQ ID NO: 169 and a VH of SEQ ID NO: 210, a VL of SEQ ID NO: 170 and a VH of SEQ ID NO: 211, a VL of SEQ ID NO: 171 and a VH of SEQ ID NO: 212, a VL of SEQ ID NO: 172 and a VH of SEQ ID NO:213, a VL of SEQ ID NO: 173 and a VH of SEQ ID NO: 214, a VL of SEQ ID NO: 174 and a VH of SEQ ID NO: 215, a VL of SEQ ID NO: 175 and a VH of SEQ ID NO: 216, or a VL of SEQ ID NO: 176 and a VH of SEQ ID NO: 217.

In one embodiment, the LukAB antibody is a LukAB antigen-binding fragment, i.e., a Fab, comprising the heavy chain variable region (VH) and first heavy chain constant domain (CH1) of an antibody coupled to the light chain variable region (VL) and light chain constant region (CL) of the antibody. In another embodiment, the LukAB antibody is a F(ab')$_2$ fragment, which comprises both LukAB antigen-binding fragments of the full-length antibody coupled by the hinge region. The heavy chain and light chain portions of exemplary LukAB Fab fragments are provided in Table 3B below. Exemplary LukAB Fab or F(ab')$_2$ fragments comprise as disclosed herein, a HC region of SEQ ID NO: 1282 and a LC region OF SEQ ID NO: 1290 (SM1B214); a HC region of SEQ ID NO: 1283 and a LC region of SEQ ID NO: 1291 (SM1B245); a HC region of SEQ ID NO: 1284 and a LC region of SEQ ID NO: 1292 (SM1B255); a HC region of SEQ ID NO: 1285 and a LC region of SEQ ID NO: 1293 (SM1B249); a HC region of SEQ ID NO: 1286 and a LC region of SEQ ID NO: 1294 (SM1B253); a HC region of SEQ ID NO: 1287 and a LC region of SEQ ID NO: 1295 (SM1B254); a HC region of SEQ ID NO: 1288 and a LC region of SEQ ID NO: 1296 (SM1B252); a HC region of SEQ ID NO: 1289 and a LC region of SEQ ID NO: 1297 (SM1B256).

TABLE 3B

LukAB Fab Amino Acid Heavy Chain (HC) and Light Chain (LC) Sequences

| Protein AA ID | Fab of | Region | Fab Amino Acid Sequence | SEQ ID NO: |
|---|---|---|---|---|
| SM1B214 | SM1B111 | HC | EVQLQQSGAELVKPGASVKISCKASGYAFS SSWMNWLKQRPGKGLEWIGRIYPGDGDTN YNGKFKGKATLTADKSSSTAYMQLSSLTSE DSAVYFCARYGYDYDGEYYYAMDYWGQG TSVTVSSASTKGPSVFPLAPSSKSTSGGTAA LGCLVKDYFPEPVTVSWNSGALTSGVHTFP AVLQSSGLYSLSSVVTVPSSSLGTQTYICNV NHKPSNTKVDKKVEPKSCHHHHHH | 1282 |
| SM1B435 | SM1B245 | HC | QVQLQQSGAELAKPGASVKMSCKSSGYTFS TYWMHWVKQRPGQGLEWIGYINPNTGYTE YNQKFKDTATLTADKSSSTAYMQLSSLTSE DSAVYYCARGGSKAFPYYAMDYWGQGTS VTVSSASTKGPSVFPLAPSSKSTSGGTAALG CLVKDYFPEPVTVSWNSGALTSGVHTFPAV LQSSGLYSLSSVVTVPSSSLGTQTYICNVNH KPSNTKVDKKVEPKSCHHHHHH | 1283 |
| SM1B436 | SM1B255 | HC | QVQLQQPGAELVKPGASVKLSCKASGYTFT RYWMHWVKQRPGQGLEWIGEINPNNGHT NYNEKFESRATLTVDKSSSTAYMQFNSLTS EDSAVYYCGRLDGHLYAVDYWGQGTSVT VSSASTKGPSVFPLAPSSKSTSGGTAALGCL VKDYFPEPVTVSWNSGALTSGVHTFPAVLQ SSGLYSLSSVVTVPSSSLGTQTYICNVNHKP SNTKVDKKVEPKSCHHHHHH | 1284 |
| SM1B441 | SM1B249 | HC | DVKLVESGGGLVKLGGSLKLSCAASGFTFS SYYMSWVRQTPEKRLELVAAINSNGGSTYY PDTVKGRFTISRDNAKNTLYLQMSSLKSED TALYYCARPDYPYAMDYWGQGTSVTVSSA STKGPSVFPLAPSSKSTSGGTAALGCLVKDY FPEPVTVSWNSGALTSGVHTFPAVLQSSGL YSLSSVVTVPSSSLGTQTYICNVNHKPSNTK VDKKVEPKSCHHHHHH | 1285 |
| SM1B442 | SM1B253 | HC | EVQLQQSGAELVKPGASVKLSCTASGFNIK DTYME1WVRQRPEQGLEWIGRIDPANDITKY DPKFQGKATITADTSSNTAYLQLSSLTSEDT AVYYCGRDWADYWGQGTTLTVSSASTKGP SVFPLAPSSKSTSGGTAALGCLVKDYFPEPV TVSWNSGALTSGVHTFPAVLQSSGLYSLSS VVTVPSSSLGTQTYICNVNHKPSNTKVDKK VEPKSCHHHHHH | 1286 |
| SM1B443 | SM1B254 | HC | EVQLQQSGAELVKPGASVKLSCTASGFNIK DTYMHWVKQRSEQGLEWIGRINPANDNTK YDPKFQGKATITADTSSNTAYLQLSSLTSED TAVYYCGRDWADYWGQGTTLTVSSASTK GPSVFPLAPSSKSTSGGTAALGCLVKDYFPE PVTVSWNSGALTSGVHTFPAVLQSSGLYSL SSVVTVPSSSLGTQTYICNVNHKPSNTKVDK KVEPKSCHHHHHH | 1287 |
| SM1B712 | SM1B252 | HC | QVQLQQSGAELMKPGASVKISCKASGYTFS DYWIEWIKQRPGHGLEWMGEILPGSDKTN YNEKFKGKATFTADSSSNTAYMQLNSLTSE DSAVFYCATAGDDYVKWGQGTLVTVSAAS TKGPSVFPLAPSSKSTSGGTAALGCLVKDYF PEPVTVSWNSGALTSGVHTFPAVLQSSGLY SLSSVVTVPSSSLGTQTYICNVNHKPSNTKV DKKVEPKSCHHHHHH | 1288 |
| SM1B791 | SM1B256 | HC | QVQLQQPGTELKMPGTSVKLSCKASGYTFT TYWMHWVKLRPGQGFEWIGEINPSNDGTN YNEKFKRKATLTVDKPSSTAYMQLSSLTSE DSTIYYCTISYYGYGDFDYWGQGTTLTVSS ASTKGPSVFPLAPSSKSTSGGTAALGCLVKD | 1289 |

TABLE 3B-continued

LukAB Fab Amino Acid Heavy Chain (HC) and Light Chain (LC) Sequences

| Protein AA ID | Fab of | Region | Fab Amino Acid Sequence | SEQ ID NO: |
|---|---|---|---|---|
| | | | YFPEPVTVSWNSGALTSGVHTFPAVLQSSG LYSLSSVVTVPSSSLGTQTYICNVNHKPSNT KVDKKVEPKSCHHHHHH | |
| SM1B214 | SM1B111 | LC | DIVMTQSPTTMAASPGERITITCSAHSNLISN YLHWYQQKPGFSPKLLIYRTSNLASGVPAR FSGSGSGTSYSLTIGTMEAEDVATYFCQQGS SIPFTFGSGTKLEIKRTVAAPSVFIFPPSDEQL KSGTASVVCLLNNFYPREAKVQWKVDNAL QSGNSQESVTEQDSKDSTYSLSSTLTLSKAD YEKHKVYACEVTHQGLSSPVTKSFNRGEC | 1290 |
| SM1B435 | SM1B245 | LC | DIVLTQSPASLAVSLGQRATMSCRASESVD GYGNSFLHWYQQKPGQPPKLLIYRASNLES GIPARFSGTGSRTDFTLTITPVEADDVATYY CQQSNGDPFTFGSGTKLEIKRTVAAPSVFIFP PSDEQLKSGTASVVCLLNNFYPREAKVQW KVDNALQSGNSQESVTEQDSKDSTYSLSST LTLSKADYEKHKVYACEVTHQGLSSPVTKS FNRGEC | 1291 |
| SM1B436 | SM1B255 | LC | DVVMTQTPLTLSVTIGQPASISCKSSQSLLDS DGETYLNWLLQRPGQSPKRLIYMVSKLDSG VPDRFTGSGSGTDFTLKISRVEAEDLGVYYC WQGTHFPQTFGGGTKLELKRTVAAPSVFIFP PSDEQLKSGTASVVCLLNNFYPREAKVQW KVDNALQSGNSQESVTEQDSKDSTYSLSST LTLSKADYEKHKVYACEVTHQGLSSPVTKS FNRGEC | 1292 |
| SM1B441 | SM1B249 | LC | QIVLTQSPAIMSASPGEKVTMTCSASSSVSY MHWYQQKSGTSPKRWIYDTSKLASGVPAR FSGSGSGTSYSLTISSMEAEDAATYYCQQWI SNPPTFGGGTKLEIKRTVAAPSVFIFPPSDEQ LKSGTASVVCLLNNFYPREAKVQWKVDNA LQSGNSQESVTEQDSKDSTYSLSSTLTLSKA DYEKHKVYACEVTHQGLSSPVTKSFNRGEC | 1293 |
| SM1B442 | SM1B253 | LC | DVVMTQTPLTLSVTIGQAASISCKSSQSLLH SDGKTYLNWLLQRPGQSPKRLIYLVSKLDS GVPDRFTGSGSGTDFTLKISRVEAEDLGVY YCWQGTHFPYTFGGGTKLEIKRTVAAPSVFI FPPSDEQLKSGTASVVCLLNNFYPREAKVQ WKVDNALQSGNSQESVTEQDSKDSTYSLSS TLTLSKADYEKHKVYACEVTHQGLSSPVTK SFNRGEC | 1294 |
| SM1B443 | SM1B254 | LC | DVVMTQTPLTLSVTVGQPASISCKSSQSLLH SDGKTYLNWLLQRPGQSPKRLIYLVSKLDS GVPDRFTGSGSGTDFTLKISRVEAEDLGVY YCWQGTHFPYTFGGGTKLEIKRTVAAPSVFI FPPSDEQLKSGTASVVCLLNNFYPREAKVQ WKVDNALQSGNSQESVTEQDSKDSTYSLSS TLTLSKADYEKHKVYACEVTHQGLSSPVTK SFNRGEC | 1295 |
| SM1B712 | SM1B252 | LC | DVLMTQTPLSLPVSLGDQASISCRSSQSIVYS NGNTYLEWYLQKPGQSPKLLIYKVSNRFSG VPDRFSGSGSGTDFTLKISRVEAEDLGVYYC FQGSHVPFTFGSGTKLEIKRTVAAPSVFIFPP SDEQLKSGTASVVCLLNNFYPREAKVQWK VDNALQSGNSQESVTEQDSKDSTYSLSSTLT LSKADYEKHKVYACEVTHQGLSSPVTKSFN RGEC | 1296 |
| SM1B791 | SM1B256 | LC | DVVMTQTPLTLSVTNGQPASISCKSSQSLLD SDGETYLNWLLQRPGQSPKRLIYLVSKLDS GVPDRFIGSGSGTDFTLKISRVEAEDLGVYF CWQGTHSPYTFGGGTKLEIKRTVAAPSVFIF PPSDEQLKSGTASVVCLLNNFYPREAKVQW KVDNALQSGNSQESVTEQDSKDSTYSLSST LTLSKADYEKHKVYACEVTHQGLSSPVTKS FNRGEC | 1297 |

In another embodiment, the LukAB Fab or F(ab')₂ fragments as disclosed above comprise a heavy chain region having an amino acid sequence that shares at least 60%, at least 65%, at least 70%, at least 75%, at least 80%, at least 85%, at least 90%, at least 91%, at least 92%, at least 93%, at least 94% at least 95%, at least 96%, at least 97%, at least 98%, at least 99% sequence identity to any one of SEQ ID NOs: 1282-1289 as shown in Table 3B, and/or a light chain region having an amino acid sequence that shares at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99% sequence identity to any one of SEQ ID NOs: 1290-1297 as shown in Table 3B. Additional LukAB Fab or F(ab')2 fragments of the present disclosure include those derived from the full-length LukAB light chain and heavy chain sequences disclosed in Table 19 below (i.e., full length LukAB light chain sequences of SEQ ID NO: 218-258 and heavy chain sequences of SEQ ID NOs: 259-286 and 811-823).

Exemplary LukAB antibodies of the present disclosure comprising the VL and VH chains as enumerated above are provided in Table 19 by their respective full-length LC and HC sequences. In particular, the amino acid sequences of the full-length light chain corresponding to and comprising the VL of SEQ ID NOs: 136-176 are provided as SEQ ID NO: 218-258 in Table 19, respectfully. The amino acid sequences of the full-length heavy chains corresponding to and comprising the VH of SEQ ID NOs: 177-217 are provided as SEQ ID NOs: 259-286 and 811-823 in Table 19, respectively.

Another aspect of the present disclosure relates to an antibody or binding portion thereof that competes for leukocidin AB binding with a monoclonal antibody, wherein said monoclonal antibody comprises a heavy chain variable region comprising a CDR-H1 of SEQ ID NO: 11, a CDR-H2 of SEQ ID NO: 31, and a CDR-H3 of SEQ ID NO: 53, and a light chain variable region comprising a CDR-L1 of SEQ ID NO: 66, a CDR-L2 of SEQ ID NO: 92, and a CDR-L3 of SEQ ID NO: 117. In accordance with this aspect of the disclosure, a competitive binding assay, such as Bio-Layer Interferometry (BLI) as described infra in Examples 2 and 3 can be utilized to identify a LukAB antibody or binding portion thereof that competes for LukAB binding with the enumerated monoclonal antibody. Other competitive binding assays known in the art can also be utilized to identify a LukAB antibody in accordance with this aspect of the disclosure.

Another aspect of the present disclosure relates to antibodies or binding portions thereof that bind *Staphylococcus aureus* Leukocidin E (LukE). LukE is an S-class subunit of another bi-component, pore-forming toxin produced and secreted by *S. aureus*. LukE, acts synergistically together with Leukocidin D (LukD), the F-class subunit of the bi-component toxin, to target and kill host immune cells expressing CCR5, CXCR1/CXCR2, or DARC receptors. In one embodiment, LukE antibodies or binding portions thereof as described herein bind a LukE protein having the amino acid sequence of SEQ ID NO: 826 (which corresponds to the native LukE amino acid sequence containing a poly-histidine tag at the N-terminus to facilitate purification), native LukE, or fragments or homologs thereof. The LukE antibody or binding portion thereof binds LukE with a Kd less than or equal to about $10^{-6}$, $10^{-7}$, $10^{-8}$, $10^{-9}$, $10^{-10}$, $10^{-11}$ or $10^{-12}$ M. In one embodiment, the LukE antibody is a neutralizing antibody, i.e., it neutralizes or prevents the cytolytic activity of LukED on its target immune host cells. Neutralizing LukE antibodies neutralize LukED cytolytic activity by binding to an epitope within regions of the LukE protein involved in LukE and LukD protein-protein interaction or involved in LukED binding to one of its cognitive receptors on target immune cells (e.g., CCR5, CXCR1/CXCR2, or DARC).

A LukE antibody or binding portion thereof as described herein comprises a heavy chain variable region that comprises: a complementarity-determining region 1 (CDR-H1) comprising an amino acid sequence of any one of SEQ ID NOs: 287-291, or a modified amino acid sequence of any one of SEQ ID NOs: 287-291, said modified sequence having at least 80% sequence identity to any one of SEQ ID NOs: 287-291; a complementarity-determining region 2 (CDR-H2) comprising an amino acid sequence of any one of SEQ ID NOs: 292-296, or a modified amino acid sequence of any one of SEQ ID NOs: 292-296, said modified sequence having at least 80% sequence identity to any one of SEQ ID NOs: 292-296; and a complementarity-determining region 3 (CDR-H3) comprising an amino acid sequence of any one of SEQ ID NOs: 297-302 or a modified amino acid sequence of any one of SEQ ID NO: 297-302 said modified sequence having at least 80% sequence identity to any one of SEQ ID NOs: 297-302. The LukE antibody heavy chain CDR1, CDR2 and CDR3 amino acid sequences are provided in Table 4 below.

TABLE 4

LukE Antibody Heavy Chain CDRs

| mAb/Fab name | VH name | HCDR1 Sequence | SEQ ID NO: | HCDR2 Sequence | SEQ ID NO: | HCDR3 Sequence | SEQ ID NO: |
|---|---|---|---|---|---|---|---|
| SM1B507 | LKEH1 | GYTFTDY | 287 | NPYNGD | 292 | GNFFD | 297 |
| SM1B508 | LKEH2 | GYSFTGY | 288 | NPYNGD | 292 | SYGYAMD | 298 |
| SM1B509 | LKEH3 | GFSLTGY | 289 | WGDGS | 293 | KGGNSPYAMD | 299 |
| SM1B510 | LKEH3 | GFSLTGY | 289 | WGDGS | 293 | KGGNSPYAMD | 299 |
| SM1B511 | LKEH6 | GYSFTGY | 288 | NPYNGD | 292 | SYGYAMD | 298 |
| SM1B512 | LKEH6 | GYSFTGY | 288 | NPYNGD | 292 | SYGYAMD | 298 |

TABLE 4-continued

LukE Antibody Heavy Chain CDRs

| mAb/Fab name | VH name | HCDR1 Sequence | SEQ ID NO: | HCDR2 Sequence | SEQ ID NO: | HCDR3 Sequence | SEQ ID NO: |
|---|---|---|---|---|---|---|---|
| SM1B513 | LKEH7 | GYSFTGY | 288 | NPYNGD | 292 | SYGYAMD | 298 |
| SM1B514 | LKEH9 | GYSFTGY | 288 | SCYSGA | 294 | GESYYVMD | 300 |
| SM1B208 | SM1H118 | GFTFSSF | 290 | SSGSSF | 295 | EGIYFYDSRYFD | 301 |
| SM1B209 | SM1H118 | GFTFSSF | 290 | SSGSSF | 295 | EGIYFYDSRYFD | 301 |
| SM1B210 | SM1H119 | GYSFTGY | 288 | SCYSGA | 294 | GESYYVMD | 300 |
| SM1B211 | SM1H120 | GYSITNGNH | 291 | SSSGS | 296 | GHYYDGSSYAMD | 302 |

The LukE antibody or binding portion thereof may further comprise a light chain variable region. Exemplary LukE light chain variable regions comprise a complementarity-determining region 1 (CDR-L1) having an amino acid sequence of any one of SEQ ID NOs: 303-309, or a modified amino acid sequence of any one of SEQ ID NO: 303-309, said modified sequence having at least 80% sequence identity to any one of SEQ ID NO: 303-309; a complementarity-determining region 2 (CDR-L2) having an amino acid sequence of any one of SEQ ID NOs: 310-313, or a modified amino acid sequence of any one of SEQ ID NO: 310-313, said modified sequence having at least 80% sequence identity to any one of SEQ ID NO: 310-313; and a complementarity-determining region 3 (CDR-L3) having an amino acid sequence of any one of SEQ ID NOs: 314-323, or a modified amino acid sequence of any one of SEQ ID NO: 314-323, said modified sequence having at least 80% sequence identity to any one of SEQ ID NO: 314-323. The LukE antibody light chain CDR1, CDR2 and CDR3 amino acid sequences are provided in Table 5 below.

TABLE 5

LukE Antibody Light Chain CDRs

| mAb/Fab name | VL name | LCDR1 Sequence | SEQ ID NO: | LCDR2 Sequence | SEQ ID NO: | LCDR3 Sequence | SEQ ID NO: |
|---|---|---|---|---|---|---|---|
| SM1B507 | LKEL1 | SSSVSY | 303 | STS | 310 | RSNYPL | 314 |
| SM1B508 | LKEL2 | SQTIVHSNGNTY | 304 | KVS | 311 | GSHVPF | 315 |
| SM1B509 | LKEL3 | SSSVSSSY | 305 | STS | 310 | WTTFPP | 316 |
| SM1B510 | IFWL470 | SQSLVHSNGNTY | 306 | KVS | 311 | STHVPP | 317 |
| SM1B511 | ATCL19 | SQSLVHSNGNTY | 306 | KVS | 311 | STHVPL | 318 |
| SM1B512 | LKEL5 | SQTIVHSNGNTY | 304 | KVS | 311 | GSHVPF | 315 |
| SM1B513 | LKEL6 | SSSVSY | 303 | STS | 310 | RSSYPW | 319 |
| SM1B514 | LKEL9 | SQDINSY | 307 | RAN | 312 | YDEFPY | 320 |
| SM1B208 | SM1L38 | SQDIVHSNGNTY | 308 | KVS | 311 | SSHFPW | 321 |
| SM1B209 | SM1L39 | SQDIVHSNGNTY | 308 | KVS | 311 | SSHFPW | 321 |
| SM1B210 | SM1L40 | SQSLVHSNGNTY | 306 | KVS | 311 | STHVPF | 322 |
| SM1B211 | SM1L41 | SESVDSYGNSF | 309 | RAS | 313 | SNEDPL | 323 |

The LukE antibodies disclosed herein comprise the heavy chain CDRs of Table 4 and light chain CDRs of Table 5 or modified CDRs thereof. Encompassed by the present disclosure are CDRs of Table 4 and 5 containing 1, 2, 3, 4, 5, or more amino acid substitutions (depending on the length of the particular CDR) that maintain or enhance LukE or LukED binding of the antibody. The resulting modified CDRs are at least 70%, at least 75%, at least 80%, at least 85%, at least 90%, at least 95% similar in sequence to the CDRs of Tables 4 and 5. Suitable amino acid modifications and insertion to the heavy chain CDR sequences of Table 4 and/or the light chain CDR sequences of Table 5 are described supra.

In one embodiment, the LukE antibody or binding portion thereof of the present disclosure comprises a heavy chain variable region comprising the CDR-H1 of SEQ ID NO: 287, the CDR-H2 of SEQ ID NO: 292, and the CDR-H3 of SEQ ID NO: 297. In another embodiment, the LukE antibody or binding portion thereof comprises a heavy chain variable region comprising the CDR-H1 of SEQ ID NO: 288, the CDR-H2 of SEQ ID NO: 292, and the CDR-H3 of SEQ ID NO: 298. In another embodiment, the LukE antibody or binding portion thereof comprises a heavy chain variable region comprising the CDR-H1 of SEQ ID NO: 289, the CDR-H2 of SEQ ID NO: 293, and the CDR-H3 of SEQ ID NO: 299. In another embodiment, the LukE antibody or binding portion thereof comprises a heavy chain variable region comprising the CDR-H1 of SEQ ID NO: 288, the CDR-H2 of SEQ ID NO: 294, and the CDR-H3 of SEQ ID NO: 300. In another embodiment, the LukE antibody or binding portion thereof comprises a heavy chain variable region comprising the CDR-H1 of SEQ ID NO: 290, the CDR-H2 of SEQ ID NO: 295, and the CDR-H3 of SEQ ID NO: 301. In another embodiment, the LukE antibody or binding portion thereof comprises a heavy chain variable region comprising the CDR-H1 of SEQ ID NO: 288, the CDR-H2 of SEQ ID NO: 294, and the CDR-H3 of SEQ ID NO: 300. In another embodiment, the LukE antibody or binding portion thereof comprises a heavy chain variable region comprising the CDR-H1 of SEQ ID NO: 291, the CDR-H2 of SEQ ID NO: 296, and the CDR-H3 of SEQ ID NO: 302.

In one embodiment, the LukE antibody or binding portion thereof of the present disclosure comprises a light chain variable region, where the light chain variable region comprises the CDR-L1 of SEQ ID NO: 303, the CDR-L2 of SEQ ID NO: 310, and the CDR-L3 of SEQ ID NO: 314. In another embodiment, the LukE antibody or binding portion thereof comprises a light chain variable region comprising the CDR-L1 of SEQ ID NO: 304, the CDR-L2 of SEQ ID NO: 311, and the CDR-L3 of SEQ ID NO: 315. In another embodiment, the LukE antibody or binding portion thereof comprises a light chain variable region comprising the CDR-L1 of SEQ ID NO: 305, the CDR-L2 of SEQ ID NO: 310, and the CDR-L3 of SEQ ID NO: 316. In another embodiment, the LukE antibody or binding portion thereof comprises a light chain variable region comprising the CDR-L1 of SEQ ID NO: 306, the CDR-L2 of SEQ ID NO: 311, and the CDR-L3 of SEQ ID NO: 317. In another embodiment, the LukE antibody or binding portion thereof comprises a light chain variable region comprising the CDR-L1 of SEQ ID NO: 306, the CDR-L2 of SEQ ID NO: 311, and the CDR L3 of SEQ ID NO: 318. In another embodiment, the LukE antibody or binding portion thereof comprises a light chain variable region comprising the CDR-L1 of SEQ ID NO: 303, the CDR-L2 of SEQ ID NO: 310, and the CDR-L3 of SEQ ID NO: 319. In another embodiment, the LukE antibody or binding portion thereof comprises a light chain variable region comprising the CDR-L1 of SEQ ID NO: 307, the CDR-L2 of SEQ ID NO: 312, and the CDR-L3 of SEQ ID NO: 320. In another embodiment, the LukE antibody or binding portion thereof comprises a light chain variable region comprising the CDR-L1 of SEQ ID NO: 308, the CDR-L2 of SEQ ID NO: 311, and the CDR-L3 of SEQ ID NO: 321. In another embodiment, the LukE antibody or binding portion thereof comprises a light chain variable region comprising the CDR-L1 of SEQ ID NO: 306, the CDR-L2 of SEQ ID NO: 311, and the CDR-L3 of SEQ ID NO: 322. In another embodiment, the LukE antibody or binding portion thereof comprises a light chain variable region comprising the CDR-L1 of SEQ ID NO: 309, the CDR-L2 of SEQ ID NO: 313, and the CDR-L3 of SEQ ID NO: 323.

In another embodiment, the LukE antibody or binding portion thereof comprises the heavy chain CDRs of SEQ ID NOs: 287, 292 and 297 together with the light chain CDRs of SEQ ID NOs: 303, 310, and 314; the heavy chain CDRs of SEQ ID NOs: 288, 292, and 298 together with the light chain CDRs of SEQ ID NOs: 304, 211, and 315; the heavy chain CDRs of SEQ ID NOs: 289, 293, 299 together with the light chain CDRs of SEQ ID NOs: 305, 310, and 316; the heavy chain CDRs of SEQ ID NOs: 289, 293, and 299 together with the light chain CDRs of SEQ ID NOs: 306, 311, and 317; the heavy chain CDRs of SEQ ID NOs: 288, 292, and 298 together with the light chain CDRs of SEQ ID NOs: 306, 311, and 318; the heavy chain CDRs of SEQ ID NOs: 288, 292, and 298 together with the light chain CDRs of SEQ ID NOs: 304, 311, and 315; the heavy chain CDRs of SEQ ID NOs: 288, 292, and 298 together with the light chain CDRs of SEQ ID NOs: 303, 310, and 319; the heavy chain CDRs of SEQ ID NOs: 288, 294, and 300 together with the light chain CDRs of SEQ ID NOs: 307, 312, and 320; the heavy chain CDRs of SEQ ID NOs: 290, 295, and 301 together with the light chain CDRs of SEQ ID NOs: 308, 311, and 321; the heavy chain CDRs of SEQ ID NOs: 288, 294, and 300 together with the light chain CDRs of SEQ ID NOs: 306, 311, and 322; and the heavy chain CDRs of SEQ ID NOs: 291, 296, and 302 together with the light chain CDRs of SEQ ID NOs: 309, 313, and 323.

The LukE antibody or binding portion thereof as described herein may comprises a variable light (VL) chain, a variable heavy (VH) chain, or a combination of a VL and VH chain. The VL chain of the LukE antibody as disclosed herein may comprise an amino acid sequence selected from SEQ ID NOs: 324-335 or an amino acid sequence that is at least 80% identical to any one of the amino acid sequence selected from SEQ ID NOs: 324-335. The VH chain of the LukE antibody as disclosed herein may comprise an amino acid sequence selected from SEQ ID NOs: 336-347 or an amino acid sequence that is at least 80% identical to any one of the amino acid sequence selected from SEQ ID NOs: 336-347. The amino acid sequences of the LukE VL and VH chains are provided in Table 6A below.

TABLE 6A

LukE Antibody Variable Light (VL) and Variable Heavy (VH) Chain Sequences

| mAb/Fab name | Region | Name | Sequence | SEQ ID NO: |
|---|---|---|---|---|
| SM1B507 | VL | LKEL1 | DIVMTQSPAIMSASPGEKVTIPCSASSSVSYMHWFQQKPG TSPKLWIYSTSNLASGVPGRFSGSGSGTSYSLTISRMEAE DAATYYCQQRSNYPLTFGAGTKLELK | 324 |
| SM1B508 | VL | LKEL2 | DVVMTQTPLSLPVSLGDQASISCRSSQTIVHSNGNTYLEW YLQKPGQSPKLLIYKVSNRFSGVPDRFSGSGSGTDFTLKI SRVEAEDLGVYYCFQGSHVPFTFGGGTKLEIR | 325 |

TABLE 6A-continued

LukE Antibody Variable Light (VL) and Variable Heavy (VH) Chain Sequences

| mAb/Fab name | Region | Name | Sequence | SEQ ID NO: |
|---|---|---|---|---|
| SM1B509 | VL | LKEL3 | DIVMTQAAAIMSASPGEKVTLTCSASSSVSSSYLYWYQQK PGSSPKLWIYSTSNLASGVPARFSGSGSGTSYSLTISSME AEDAASYFCHQWTTFPPTFGGGTKLEIK | 326 |
| SM1B510 | VL | IFWL470 | DVVMTQTPLSLPVSLGDQASISCRSSQSLVHSNGNTYLHW YLQKPGQSPKLLIYKVSNRFSGVPDRFSGSGSGTDFTLKI SRVEAEDLGVYFCSQSTHVPPTFGGGTKLEIK | 327 |
| SM1B511 | VL | ATCL19 | DVVMTQTPLSLPVSLGDQASISCRSSQSLVHSNGNTYLHW YLQKPGQSPKLLIYKVSNRFSGVPDRFSGSGSGTDFTLKI SRVEAEDLGVYFCSQSTHVPLTFGAGTKLELK | 328 |
| SM1B512 | VL | LKEL5 | DIKMTQSPLSLPVSLGDQASISCRSSQTIVHSNGNTYLEW YLQKPGQSPKLLIYKVSNRFSGVPDRFSGSGSGTDFTLKI SRVEAEDLGVYYCFQGSHVPPTFGGGTKLEIR | 329 |
| SM1B513 | VL | LKEL6 | DIVLTQSPAIMSASPGEKVTITCSASSSVSYMHWFQQKPG TSPKLWIYSTSNLASGVPARFSGSGSGTSYSLTISRMEAE DAATYYCQQRSSYPWTFGGGTKLEIK | 330 |
| SM1B514 | VL | LKEL9 | DIVMTQSPSSMYASLGERVTITCKASQDINSYLSWFQQKP GKSPKTLIYRANRLVDGVPSRFSGSGSGQDYSLTISSLEY EDMGIYYCLQYDEFPYTFGGGTKLEIK | 331 |
| SM1B208 | VL | SM1L38 | DIVMTQSPLSLPVSLGDQASISCRSSQDIVHSNGNTYLGW YLQKPGRSPKLLIYKVSNRFSGVPDRFSGSGSGTDFTLKI SRVEAEDLGVYYCFQSSHFPWTFGGGTRLEIK | 332 |
| SM1B209 | VL | SM1L39 | DVVMTQTPLSLPVSLGDQASISCRSSQDIVHSNGNTYLGW YLQKPGRSPKLLIYKVSNRFSGVPDRFSGSGSGTDFTLKI SRVEAEDLGVYYCFQSSHFPWTFGGGTRLEIK | 333 |
| SM1B210 | VL | SM1L40 | DIVLTQSPLSLPVSLGDQASISCRSSQSLVHSNGNTYLHW YLQKPGQSPKLLIYKVSNRFSGVPDRFSGSGSGTDFTLKI SRVEAEDLGVYFCSQSTHVPFTFGSGTKLEIK | 334 |
| SM1B211 | VL | SM1L41 | DIVLTQSPASLAVSLGQRATISCRASESVDSYGNSFMHWY QQKPGQPPKLLIYRASNLESGIPARFSGSGSRTDFTLTIN PVEADDVATYYCQQSNEDPLTFGAGTKLELK | 335 |
| SM1B507 | VH | LKEH1 | EVQLQQSGAELVKPGASVKMSCKASGYTFTDYYMDWVKQS HGKSFEWIGHVNPYNGDTRYNQKFKGKATLTVDKSSTTAY MELNSLTSEDSAVYYCARGNFFDWGQGTTLSVSS | 336 |
| SM1B508 | VH | LKEH2 | EVQLQQSGAELVKPGASVKISCKTSGYSFTGYFMNWVMQS HGKSLEWIGRINPYNGDTFYNQKFKGKATLTVDKSSSTAH MELRSLASEDSAVYYCARSYGYAMDYWGQGTSVTVSS | 337 |
| SM1B509 | VH | LKEH3 | QVQLKESGPGLVAPSQSLSITCTVSGFSLTGYGVNWVRQP PGKGLEWLGLMWDGSTDYNSALNSRLRINKDNSKSQVFL KMSSLQTDDTAIYYCVRKGGNSPYAMDYWGQGTSVTVSS | 338 |
| SM1B510 | VH | LKEH3 | QVQLKESGPGLVAPSQSLSITCTVSGFSLTGYGVNWVRQP PGKGLEWLGLMWDGSTDYNSALNSRLRINKDNSKSQVFL KMSSLQTDDTAIYYCVRKGGNSPYAMDYWGQGTSVTVSS | 339 |
| SM1B511 | VH | LKEH6 | EVKLVESGPELVKPGASVKISCKTSGYSFTGYFMNWVMQS HGKSLEWIGRINPYNGDTFYNQKFKGKATLTVDKSSSTAH MELRSLASEDSAVYYCARSYGYAMDYWGQGTSVTVSS | 340 |
| SM1B512 | VH | LKEH6 | EVKLVESGPELVKPGASVKISCKTSGYSFTGYFMNWVMQS HGKSLEWIGRINPYNGDTFYNQKFKGKATLTVDKSSSTAH MELRSLASEDSAVYYCARSYGYAMDYWGQGTSVTVSS | 341 |
| SM1B513 | VH | LKEH7 | EVQLQQSGPELVKPGASVKISCKASGYSFTGYFMNWVMQS HGKSLEWIGRINPYNGDTFYNQKFKAKATLTVDKSSNTAH MELRSLASEDSAVYFCARSYGYAMDYWGLGTSVTVSS | 342 |

TABLE 6A-continued

LukE Antibody Variable Light (VL) and Variable Heavy (VH) Chain Sequences

| mAb/Fab name | Region | Name | Sequence | SEQ ID NO: |
|---|---|---|---|---|
| SM1B514 | VH | LKEH9 | EVQLQQSGPELVKTGASVKISCKASGYSFTGYYMHWVKQS HGKSLEWIGYLSCYSGATSYNQKFKGKATFTVDTSSTTAY MQFNSLTSEDSAVYYCARGESYYVMDYWGQGTSVTVSS | 343 |
| SM1B208 | VH | SM1H118 | EVQLQQSGGGSVQPGGSRKLSCAASGFTFSSFGMHWVRQA PEKGLEWVAYISSGSSFIYYGDTVKGRFTISRDNPNNTLF LQMTSLRSEDTAIYYCAREGIYFYDSRYFDVWGAGTTVTV SS | 344 |
| SM1B209 | VH | SM1H118 | EVQLQQSGGGSVQPGGSRKLSCAASGFTFSSFGMHWVRQA PEKGLEWVAYISSGSSFIYYGDTVKGRFTISRDNPNNTLF LQMTSLRSEDTAIYYCAREGIYFYDSRYFDVWGAGTTVTV SS | 345 |
| SM1B210 | VH | SM1H119 | EFQLQQSGPELVKTGASVKISCKASGYSFTGYYMHWVKQS HGRSLEWIGYLSCYSGATSYNQKFKGKATFTVDTSSTTAY MQFNSLTSEDSAVYYCARGESYYVMDYWGQGTSVTVSS | 346 |
| SM1B211 | VH | SM1H120 | EVQLQQSGPGLVKPSQTVSLTCTVTGYSITNGNHWWNWIR QVSGSKLEWIGYISSSGSTDSNPSLKSRISITRDTSKNQL FLQLNSVTTEDIATYYCARGHYYDGSSYAMDYWGQGTSVT VSS | 347 |

In another embodiment, the antibody or binding fragment thereof comprises a VH region having an amino acid sequence that shares at least 60%, at least 65%, at least 70%, at least 75%, at least 80%, at least 85%, at least 90%, at least 910%, at least 92%, at least 930%, at least 94% at least 95%, at least 96%, at least 97%, at least 98%, at least 99% sequence identity to any one of SEQ ID NOs: 336-347 as shown in Table 6A, and/or a VL region having an amino acid sequence that shares at least 60%, at least 65%, at least 70%, at least 75%, at least 80%, at least 85%, at least 90%, at least 91%, at least 92%, at least 93%, at least 94% at least 95%, at least 96%, at least 97%, at least 98%, at least 99% sequence identity to any one of SEQ ID NOs: 324-335 as shown in Table 6A.

In one embodiment, the antibody or binding fragment thereof of the present disclosure comprises a humanized VH variant of any one of SEQ ID NOs: 336-347 and/or a humanized VL variant of any one of SEQ ID NOs: 324-335, where the framework regions are humanized or replaced with human immunoglobulin framework sequences. The humanized framework regions are designed to be similar in length and sequence to the parental framework sequences within SEQ ID NOs: 324-347, respectively. In one embodiment, the humanized framework regions share 50%, 55%, 60%, 65%, 70%, 75%, 80%, 85%, 90%, 95% or more sequence identity to the framework regions of any one of SEQ ID NOs: 324-347, respectively. In another embodiment, the humanized framework regions are 60%, 65%, 70%, 75%, 80%, 85%, 90%, 95% or more similar in length to the framework regions of any one of SEQ ID NOs: 324-347, respectively. Humanized variants of the VH of any one of SEQ ID NOs: 336-347 and the VL of any one of SEQ ID NOs: 324-335 share at least 50%, at least 55%, at least 60%, at least 65%, at least 70%, at least 75%, at least 80%, at least 85%, at least 90%, at least 95% sequence identity along the entire length of SEQ ID NOs: 336-347 and SEQ ID NOs: 324-335, respectively.

Suitable LukE antibodies as disclosed herein comprise a VL of SEQ ID NO: 324 and a VH of SEQ ID NO: 336; a VL of SEQ ID NO: 325 and a VH of SEQ ID NO: 337; a VL of SEQ ID NO: 326 and a VH of SEQ ID NO: 338; a VL of SEQ ID NO: 327 and a VH of SEQ ID NO: 339; a VL of SEQ ID NO: 328 and a VH of SEQ ID NO: 340; a VL of SEQ ID NO: 329 and a VH of SEQ ID NO: 341; a VL of SEQ ID NO: 330 and a VH of SEQ ID NO: 342; a VL of SEQ ID NO: 331 and a VH of SEQ ID NO: 343; a VL of SEQ ID NO: 332 and a VH of SEQ ID NO: 344; a VL of SEQ ID NO: 333 and a VH of SEQ ID NO: 345; a VL of SEQ ID NO: 334 and a VH of SEQ ID NO: 346; or a VL of SEQ ID NO: 335 and a VH of SEQ ID NO: 347.

In one embodiment, the LukE antibody is a LukE antigen-binding fragment, i.e., a Fab, comprising the heavy chain variable region (VH) and first heavy chain constant domain (CH1) of an antibody coupled to the light chain variable region (VL) and light chain constant region (CL) of the antibody. In another embodiment, the LukE antibody is a F(ab')$_2$ fragment, which comprises both LukE antigen-binding fragments of the full-length antibody coupled by the hinge region. The heavy chain and light chain portions of exemplary LukE Fab fragments are provided in Table 6B below. Exemplary LukE Fab or F(ab')$_2$ fragments comprise as disclosed herein, a HC region of SEQ ID NO: 1298 and a LC region OF SEQ ID NO: 1301 (SM1B507); a HC region of SEQ ID NO: 1299 and a LC region of SEQ ID NO: 1302 (SM1B508); a HC region of SEQ ID NO: 1300 and a LC region of SEQ ID NO: 1303 (SM1B512).

TABLE 6B

LukE Fab Amino Acid Heavy Chain (HC) and Light Chain (LC) Sequences

| Protein AA ID | Fab of | Region | Fab Amino Acid Sequence | SEQ ID NO: |
|---|---|---|---|---|
| SM1B709 | AM1B507 | HC | EVQLQQSGAELVKPGASVKMSCKASGYTFTDYY MDWVKQSHGKSFEWIGHVNPYNGDTRYNQKFKG KATLTVDKSSTTAYMELNSLTSEDSAVYYCARG NFFDWGQGTTLSVSSASTKGPSVFPLAPSSKST SGGTAALGCLVKDYFPEPVTVSWNSGALTSGVH TFPAVLQSSGLYSLSSVVTVPSSSLGTQTYICN VNHKPSNTKVDKKVEPKSCHHHHHH | 1298 |
| SM1B710 | SM1B508 | HC | EVQLQQSGAELVKPGASVKISCKTSGYSFTGYF MNWVMQSHGKSLEWIGRINPYNGDTFYNQKFKG KATLTVDKSSSTAHMELRSLASEDSAVYYCARS YGYAMDWGQGTSVTVSSASTKGPSVFPLAPSSK STSGGTAALGCLVKDYFPEPVTVSWNSGALTSG VHTFPAVLQSSGLYSLSSVVTVPSSSLGTQTYI CNVNHKPSNTKVDKKVEPKSCHHHHHH | 1299 |
| SM1B711 | SM1B512 | HC | EVKLVESGPELVKPGASVKISCKTSGYSFTGYF MNWVMQSHGKSLEWIGRINPYNGDTFYNQKFKG KATLTVDKSSSTAHMELRSLASEDSAVYYCARS YGYAMDWGQGTSVTVSSASTKGPSVFPLAPSSK STSGGTAALGCLVKDYFPEPVTVSWNSGALTSG VHTFPAVLQSSGLYSLSSVVTVPSSSLGTQTYI CNVNHKPSNTKVDKKVEPKSCHHHHHH | 1300 |
| SM1B709 | SM1B507 | LC | DIVMTQSPAIIVISASPGEKVTIPCSASSSVSY MHWFQQKPGTSPKLWIYSTSNLASGVPGRFSGS GSGTSYSLTISRMEAEDAATYYCQQRSNYPLTF GAGTKLELKRTVAAPSVFIFPPSDEQLKSGTAS VVCLLNNFYPREAKVQWKVDNALQSGNSQESVT EQDSKDSTYSLSSTLTLSKADYEKHKVYACEVT HQGLSSPVTKSFNRGEC | 1301 |
| SM1B710 | SM1B508 | LC | DVVMTQTPLSLPVSLGDQASISCRSSQTIVHSN GNTYLEWYLQKPGQSPKLLIYKVSNRFSGVPDR FSGSGSGTDFTLKISRVEAEDLGVYYCFQGSHV PFTFGGGTKLEIRRTVAAPSVFIFPPSDEQLKS GTASVVCLLNNFYPREAKVQWKVDNALQSGNSQ ESVTEQDSKDSTYSLSSTLTLSKADYEKHKVYA CEVTHQGLSSPVTKSFNRGEC | 1302 |
| SM1B711 | SM1B512 | LC | DIKMTQSPLSLPVSLGDQASISCRSSQTIVHSN GNTYLEWYLQKPGQSPKLLIYKVSNRFSGVPDR FSGSGSGTDFTLKISRVEAEDLGVYYCFQGSHV PFTFGGGTKLEIRRTVAAPSVFIFPPSDEQLKS GTASVVCLLNNFYPREAKVQWKVDNALQSGNSQ ESVTEQDSKDSTYSLSSTLTLSKADYEKHKVYA CEVTHQGLSSPVTKSFNRGEC | 1303 |

In another embodiment, the LukE Fab or F(ab')₂ fragments as disclosed above comprise a heavy chain region having an amino acid sequence that shares at least 60%, at least 65%, at least 70%, at least 75%, at least 80%, at least 85%, at least 90%, at least 91%, at least 92%, at least 93%, at least 94% at least 95%, at least 96%, at least 97%, at least 98%, at least 99% sequence identity to any one of SEQ ID NOs: 1298-1300 as shown in Table 6B, and/or a light chain region having an amino acid sequence that shares at least 60%, at least 65%, at least 70%, at least 75%, at least 80%, at least 85%, at least 90%, at least 91%, at least 92%, at least 93%, at least 94% at least 95%, at least 96%, at least 97%, at least 98%, at least 99% sequence identity to any one of SEQ ID NOs: 1301-1303 as shown in Table 6B. Additional LukE Fab or F(ab')2 fragments of the present disclosure include those derived from the full-length LukE light chain and heavy chain sequences disclosed in Table 20 below (i.e., full length LukE light chain sequences of SEQ ID NO: 348-359 and heavy chain sequences of SEQ ID NOs: 360-371).

Exemplary LukE antibodies of the present disclosure comprising the VL and VH chains as enumerated above are provided in Table 20 by their respective full-length LC and HC sequences. In particular, the amino acid sequences of the full-length light chain corresponding to and comprising the VL of SEQ ID NOs: 324-335 are provided as SEQ ID NO: 348-359 in Table 20, respectfully. The amino acid sequences of the full-length heavy chains corresponding to and comprising the VH of SEQ ID NOs: 336-347 are provided as SEQ ID NOs: 360-371 in Table 20, respectively.

Another aspect of the present disclosure is directed to an antibody or binding portion thereof that competes for leukocidin E binding with a monoclonal antibody, wherein said monoclonal antibody comprises a heavy chain variable region comprising a CDR-H1 of SEQ ID NO: 290, a CDR-H2 of SEQ ID NO: 295, and a CDR-H3 of SEQ ID NO: 301, and a light chain variable region comprising the CDR-L1 of SEQ ID NO: 308, the CDR-L2 of SEQ ID NO: 311, and the CDR-L3 of SEQ ID NO: 321. In accordance with this aspect of the disclosure, a competitive binding assay, such as BLI as described infra in Examples 2 and 3 can be utilized to identify a LukE antibody or binding portion thereof that competes for LukE binding with the enumerated monoclonal antibody. Other competitive binding assays known in the art can also be utilized to identify a LukE antibody in accordance with this aspect of the disclosure.

Another aspect of the present disclosure relates to antibodies or binding portions thereof that bind *Staphylococcus aureus* Leukocidin D (LukD). In one embodiment, LukD antibodies or binding portions thereof as described herein bind a LukD protein having the amino acid sequence of SEQ ID NO: 825 (which corresponds to the native LukD amino acid sequence containing a poly-histidine tag at the N-terminus to facilitate purification), native LukD protein, or fragments or homologs thereof. In one embodiment, the LukD antibody is a neutralizing antibody, i.e., it neutralizes or prevents the cytolytic activity of LukED on its target immune host cells. The LukD antibody or binding portion thereof binds LukD with a Kd less than or equal to about $10^{-6}$, $10^{-7}$, $10^{-8}$, $10^{-9}$, $10^{-10}$, $10^{-11}$ or $10^{-12}$ M. Neutralizing LukD antibodies neutralize LukED cytolytic activity by binding to an epitope within regions of the LukD protein involved in LukD and LukE protein-protein interaction or involved in LukED binding to one of its cognitive receptors on target immune cells (e.g., CCR5, CXCR1/CXCR2, or DARC).

A LukD antibody or binding portion thereof of the present disclosure comprises a heavy chain variable region that comprises: a complementarity-determining region 1 (CDR-H1) comprising an amino acid sequence of any one of SEQ ID NOs: 372-374, or a modified amino acid sequence of any one of SEQ ID NOs: 372-374, said modified sequence having at least 80% sequence identity to any one of SEQ ID NOs: 372-374; a complementarity-determining region 2 (CDR-H2) comprising an amino acid sequence of any one of SEQ ID NOs: 375-379, or a modified amino acid sequence of any one of SEQ ID NOs: 375-379, said modified sequences having at least 80% sequence identity to any one of SEQ ID NOs: 375-379; and a complementarity-determining region 3 (CDR-H3) comprising an amino acid sequence of any one of SEQ ID NOs: 380-383, or a modified amino acid sequence of any one of SEQ ID NO: 380-383, said modified sequence having at least 80% sequence identity to any one of SEQ ID NOs: 380-383. The LukD antibody heavy chain CDR1, CDR2 and CDR3 amino acid sequences are provided in Table 7 below.

TABLE 7

LukD Antibody Heavy Chain CDRs

| mAb/Fab name | name | HCDR1 Sequence | SEQ ID NO: | HCDR2 Sequence | SEQ ID NO: | HCDR3 Sequence | SEQ ID NO: |
|---|---|---|---|---|---|---|---|
| SM1B221 | LKDH1 | GYTFTDY | 372 | DTSDSY | 375 | DYGYAMD | 380 |
| SM1B222 | LKDH2 | GYTFTDY | 372 | FPGNSD | 376 | TELD | 381 |
| SM1B223 | LKDH3 | GYTFTDY | 372 | DTSDSY | 375 | DYGYAMD | 380 |
| SM1B224 | LKDH4 | GYTFTDY | 372 | DASDSY | 377 | DFGYAMD | 380 |
| SM1B225 | LKDH5 | GFTFSSY | 373 | TGGGTY | 378 | HRDGNYGCFD | 382 |
| SM1B226 | LKDH6 | GYTFTDY | 372 | DTSDSY | 375 | DYGYAMD | 380 |
| SM1B227 | LKDH7 | GYTFTSY | 374 | NPYNAD | 379 | SAMD | 383 |
| SM1B228 | LKDH8 | GYTFTDY | 372 | DTSDSY | 375 | DYGYAMD | 380 |

The LukD antibody or binding portion thereof may further comprise a light chain variable region. Exemplary LukD light chain variable regions comprise a complementarity-determining region 1 (CDR-L1) having an amino acid sequence of any one of SEQ ID NOs: 384-387, or a modified amino acid sequence of any one of SEQ ID NO: 384-387, said modified sequence having at least 80% sequence identity to any one of SEQ ID NO: 384-387; a complementarity-determining region 2 (CDR-L2) having an amino acid sequence of any one of SEQ ID NOs: 388-391, or a modified amino acid sequence of any one of SEQ ID NO: 388-391, said modified sequence having at least 80% sequence identity to any one of SEQ ID NO: 388-391; and a complementarity-determining region 3 (CDR-L3) having an amino acid sequence of any one of SEQ ID NOs: 392-397, or a modified amino acid sequence of any one of SEQ ID NO: 392-397, said modified sequence having at least 80% sequence identity to any one of SEQ TD NO: 392-397. The LukD antibody light chain CDR1, CDR2 and CDR3 amino acid sequences are provided in Table 8 below.

TABLE 8

LukD Antibody Light Chain CDRs

| mAb/Fab name | VL name | LCDR1 Sequence | SEQ ID NO: | LCDR2 Sequence | SEQ ID NO: | LCDR3 Sequence | SEQ ID NO: |
|---|---|---|---|---|---|---|---|
| SM1B221 | LKDL1 | SLSVSY | 384 | SAS | 388 | RSSYPF | 392 |
| SM1B222 | LKDL2 | SQSLIHNDGNTY | 385 | KVS | 389 | STHVPF | 393 |
| SM1B223 | LKDL3 | SLSVSF | 384 | SAS | 388 | RSSYPF | 392 |
| SM1B224 | LKDL4 | SSSVSF | 386 | STS | 390 | RSTYPY | 394 |
| SM1B225 | LKDL5 | SSSVSSSY | 387 | STS | 390 | YHRSPQ | 395 |
| SM1B226 | LKDL6 | SSSVSF | 386 | SAS | 388 | RSSYPY | 396 |
| SM1B227 | LKDL7 | SSSVSY | 386 | DTS | 391 | GSGYPL | 397 |
| SM1B228 | LKDL8 | SSSVSY | 386 | SAS | 388 | RSSYPF | 392 |

The LukD antibodies disclosed herein comprise the heavy chain CDRs of Table 7 and light chain CDRs of Table 8 or modified CDRs thereof. Encompassed by the present disclosure are CDRs of Table 7 and 8 containing 1, 2, 3, 4, 5, or more amino acid substitutions that maintain or enhance LukD or LukED binding of the antibody. The resulting modified CDRs are at least 70%, at least 75%, at least 80%, at least 85%, at least 90%, at least 95% similar in sequence to the CDRs of Tables 7 and 8. Suitable amino acid modifications and insertion to the heavy chain CDR sequences of Table 7 and/or the light chain CDR sequences of Table 8 are described supra.

In one embodiment, the LukD antibody or binding portion thereof of the present disclosure comprises a heavy chain variable region comprising the CDR-H1 of SEQ ID NO: 372, the CDR-H2 of SEQ ID NO: 375, and the CDR-H3 of SEQ ID NO: 380. In another embodiment, the LukD antibody or binding portion thereof comprises a heavy chain variable region comprising the CDR-H1 of SEQ ID NO: 372, the CDR-H2 of SEQ ID NO: 376, and the CDR-H3 of SEQ ID NO: 381. In another embodiment, the LukD antibody or binding portion thereof comprises a heavy chain variable region comprising the CDR-H1 of SEQ ID NO: 372, the CDR-H2 of SEQ ID NO: 377, and the CDR-H3 of SEQ ID NO: 380. In another embodiment, the LukD antibody or binding portion thereof comprises a heavy chain variable region comprising the CDR-H1 of SEQ ID NO: 373, the CDR-H2 of SEQ ID NO: 378, and the CDR-H3 of SEQ ID NO: 382. In another embodiment, the LukD antibody or binding portion thereof comprises a heavy chain variable region comprising the CDR-H1 of SEQ ID NO: 374, the CDR-H2 of SEQ ID NO: 379, and the CDR-H3 of SEQ ID NO: 383.

In another embodiment, the LukD antibody or binding portion thereof of the present disclosure comprises a light chain variable region comprising the CDR-L1 of SEQ ID NO: 384, the CDR-L2 of SEQ ID NO: 388, and the CDR-L3 of SEQ ID NO: 392. In another embodiment, the LukD antibody or binding portion thereof comprises a light chain variable region comprising the CDR-L1 of SEQ ID NO: 385, the CDR-L2 of SEQ ID NO: 389, and the CDR-L3 of SEQ ID NO: 393. In another embodiment, the LukD antibody or binding portion thereof comprises a light chain variable region comprising the CDR-L1 of SEQ ID NO: 386, the CDR-L2 of SEQ ID NO: 390, and the CDR-L3 of SEQ ID NO: 394. In another embodiment, the LukD antibody or binding portion thereof comprises a light chain variable region comprising the CDR-L1 of SEQ ID NO: 387, the CDR-L2 of SEQ ID NO: 390, and the CDR-L3 of SEQ ID NO: 395. In another embodiment, the LukD antibody or binding portion thereof comprises a light chain variable region comprising the CDR-L1 of SEQ ID NO: 386, the CDR-L2 of SEQ ID NO: 388, and the CDR-L3 of SEQ ID NO: 396. In another embodiment, the LukD antibody or binding portion thereof comprises a light chain variable region comprising the CDR-L1 of SEQ ID NO: 386, the CDR-L2 of SEQ ID NO: 391, and the CDR-L3 of SEQ ID NO: 397. In another embodiment, the LukD antibody or binding portion thereof comprises a light chain variable region comprising the CDR-L1 of SEQ ID NO: 386, the CDR-L2 of SEQ ID NO: 388, and the CDR-L3 of SEQ ID NO: 392.

In another embodiment, the LukD antibody or binding portion thereof comprises the heavy chain CDRs of SEQ ID NOs: 372, 375 and 380 together with the light chain CDRs of SEQ ID NOs: 384, 388, and 392; the heavy chain CDRs of SEQ ID NOs: 372, 376, and 381 together with the light chain CDRs of SEQ ID NOs: 385, 389, and 393; the heavy chain CDRs of SEQ ID NOs: 372, 377, and 380 together with the light chain CDRs of SEQ ID NOs: 386, 390, and 394; the heavy chain CDRs of SEQ ID NOs: 373, 378, and 382 together with the light chain CDRs of SEQ ID NOs: 387, 390, and 395; the heavy chain CDRs of SEQ ID NOs: 372, 375, and 380 together with the light chain CDRs of SEQ ID NOs: 386, 388 and 396; the heavy chain CDRs of SEQ ID NOs: 374, 379, and 383 together with the light chain CDRs of SEQ ID NOs: 386, 391, and 397; the heavy chain CDRs of SEQ ID NOs: 372, 375, and 380 together with the light chain CDRs of SEQ ID NOs: 386, 388, and 392.

The LukD antibody or binding portion thereof as described herein may comprises a variable light (VL) chain, a variable heavy (VH) chain, or a combination of a VL and VH chain. The VL chain of the LukD antibody as disclosed herein may comprise an amino acid sequence selected from SEQ ID NOs: 398-405 or an amino acid sequence that is at least 80% identical to any one of the amino acid sequence selected from SEQ ID NOs: 398-405. The VH chain of the LukD antibody as disclosed herein may comprise an amino acid sequence selected from SEQ ID NOs: 406-413 or an amino acid sequence that is at least 80% identical to any one of the amino acid sequence selected from SEQ ID NOs: 406-413. The amino acid sequences of the LukD VL and VH chains are provided in Table 9A below.

TABLE 9A

LukD Antibody Variable Light (VL) and
Variable Heavy (VH) Chain Sequences

| mAb/Fab name | Region | Name | Sequence | SEQ ID NO: |
|---|---|---|---|---|
| SM1B221 | VL | LKDL1 | QIVLTQSPAIMSASPGEKVTITCSASLSVSYMHWFQQKP GTSPKLWIYSASNLASGVPARFSGSGSGTSYSLTISRME AEDAATYYCQQRSSYPFTFGSGTKLEIK | 398 |
| SM1B222 | VL | LKDL2 | DVVMTQTPLSLPVSLGDQASISCRSSQSLIHNDGNTYLH WYLQKPGQSPKLLIYKVSNRFSGVPDRFSGSGSGTDFTV KISRVEAEDLGVYFCSQSTHVPFTFGAGTKLELK | 399 |
| SM1B223 | VL | LKDL3 | QIVLSQSPAIMSASPGEKVTITCSASLSVSFMHWFQQKP GTSPKLWIYSASNLASGVPARFSGSGSGTSYSLTISRME AEDAATYYCQQRSSYPFTFGSGTKLEIK | 400 |
| SM1B224 | VL | LKDL4 | QIVLTQSPAIMSASPGEKVTITCSASSSVSFMHWFQQKP GTSPKLWIYSTSNLASGVPARFSGSGSGTSYSLTISRME AEDAATYYCQQRSTYPYTFGGGTKMEIK | 401 |
| SM1B225 | VL | LKDL5 | DIVLTQSPAIMSASLGERVTMTCTASSSVSSSYLHWYQQ KPGSSPKLWVYSTSNLASGVPARFSGSGSGSSYSLTISS MEPEDTATYYCHQYHRSPQTFGGGTKLEIK | 402 |
| SM1B226 | VL | LKDL6 | QIVLTQSPAIMSASPGEKVTITCSASSSVSFMHWFQQKP GTSPKLWIYSASNLASGVPARFSGSGSGTSYSLTISRME AEDAATYYCQQRSSYPYTFGGGTKLEIK | 403 |
| SM1B227 | VL | LKDL7 | DIVLTQSPAIMSASPGEKVTMTCSASSSVSYMHWYQQKS STSPKLWIYDTSKLASGVPGRFSGSGSGNSYSLTISSME AEDVATYYCFQGSGYPLTFGSGTKLEIK | 404 |
| SM1B228 | VL | LKDL8 | QIVLTQSPAIMSASPGEKVTITCSASSSVSYMHWFQQKP GTSPKLWIYSASNLASGVPARFSGSGSGTSYSLTISRME AEDAATYYCQQRSSYPFTFGSGTKLEIK | 405 |
| SM1B221 | VH | LKDH1 | QVQLQQSGAELVMPGASVKMSCKASGYTFTDYWMHWVKQ RPGQGLEWIGAIDTSDSYTSYNQKFKGKATLTVDESSST AYMQLSSLTSEDSAVYYCARDYGYAMDYWGQGTSVTVSS | 406 |
| SM1B222 | VH | LKDH2 | EVQLQQSGAMLARPGASVTMSCKASGYTFTDYWMHWVRQ GPGQGLEWIGAIFPGNSDTTYNQKFRGKAKLTAVTSAIT AYMEVSSLTNIDSAVYYCTVTELDYWGQGTTLTVSS | 407 |
| SM1B223 | VH | LKDH3 | EVQLQQSGADLVMPGTSMKLSCKASGYTFTDYWIHWVK QGPGQGLEWIGAIDTSDSYINYNQKFTDKATLTVDESS STAYMHLSSLTSEDSAVYYCARDYGYAMDYWGQGTSVT VSS | 408 |
| SM1B224 | VH | LKDH4 | QVQLQQPGAELVMPGSSVKMSCKASGYTFTDYWMHWVK QRPGQGLEWIGAIDASDSYTSYDQKFKGKATLTVDDSS STAYIHLNSLTSEDSAVYYCARDFGYAMDYWGQGTSVT VSS | 409 |
| SM1B225 | VH | LKDH5 | EVQLQQSGGGLVKPGGSLKLSCAASGFTFSSYAMSWVR QTPEKRLEWVATITGGGTYTYYLDSVKGRFTISRDNAK TSLYLQMSSLRSEDTAMYYCAREIRDGNYGCFDVWGAG TTVTVSS | 410 |
| SM1B226 | VH | LKDH6 | EVQLQQSGAELVMPGASVKMSCKASGYTFTDYWMHWVL QRPGQGLEWIGAIDTSDSYTTYNQKFKGKATLTVDESS STAYMLLSSLTSEDSAVYYCARDYGYAMDYWGQGSSVT VSS | 411 |
| SM1B227 | VH | LKDH7 | EFQLQQSGPELVKPGASVKMSCKASGYTFTSYFIHWVK QKPGQGLEWIGFINPYNADTNYNEKFKGKATLTSDKSS STAYMELSSLTSEDSAVYYCTPSAMDYWGQGTSVTVSS | 412 |
| SM1B228 | VH | LKDH8 | QVQLQQSGAELVMPGASVKMSCKASGYTFTDYWMHWVK QRPGQGLEWIGAIDTSDSYTTYNQKFKGKATLTVDESS STAYMQLSSLTSEDSAVYYCARDYGYAMDYWGQGTSVT VSS | 413 |

In another embodiment, the LukD antibody or binding fragment thereof comprises a VH region having an amino acid sequence that shares at least 60%, at least 65%, at least 70%, at least 75%, at least 80%, at least 85%, at least 90%, at least 91%, at least 92%, at least 93%, at least 94% at least 95%, at least 96%, at least 97%, at least 98%, at least 99% sequence identity to any one of SEQ ID NOs: 406-413 as shown in Table 9A, and/or a VL region having an amino acid sequence that shares at least 60%, at least 65%, at least 70%, at least 75%, at least 80%, at least 85%, at least 90%, at least 91%, at least 92%, at least 93%, at least 94% at least 95%, at least 96%, at least 97%, at least 98%, at least 99% sequence identity to any one of SEQ ID NOs: 398-405 as shown in Table 9A.

In one embodiment, the antibody or binding fragment thereof of the present disclosure comprises a humanized VH variant of any one of SEQ ID NOs: 406-413 and/or a humanized VL variant of any one of SEQ ID NOs: 398-405, where the framework regions are humanized or replaced with human immunoglobulin framework sequences. The humanized framework regions are designed to be similar in length and sequence to the parental framework sequences within SEQ ID NOs: 398-413, respectively. In one embodiment, the humanized framework regions share 50%, 55%, 60%, 65%, 70%, 75%, 80%, 85%, 90%, 95% or more sequence identity to the framework regions of any one of SEQ ID NOs: 398-413, respectively. In another embodiment, the humanized framework regions are 60%, 65%, 70%, 75%, 80%, 85%, 90%, 95% or more similar in length to the framework regions of any one of SEQ ID NOs: 398-413, respectively. Humanized variants of the VH of any one of SEQ ID NOs: 406-413 and the VL of any one of SEQ ID NOs: 398-405 share at least 50%, at least 55%, at least 60% at least 65%, at least 70%, at least 75%, at least 80%, at least 85%, at least 90%, at least 95% sequence identity along the entire length of SEQ ID NOs: 406-413 and SEQ ID NOs: 398-405, respectively.

Exemplary LukD antibodies as disclosed herein comprise a VL of SEQ ID NO: 398 and a VH of SEQ ID NO: 406; a VL of SEQ ID NO: 399 and a VH of SEQ ID NO: 407; a VL of SEQ ID NO: 400 and a VH of SEQ ID NO: 408; a VL of SEQ ID NO: 401 and a VH of SEQ ID NO: 409; a VL of SEQ ID NO: 402 and a VH of SEQ ID NO: 410; a VL of SEQ ID NO: 403 and a VH of SEQ ID NO: 411; a VL of SEQ ID NO: 404 and a VH of SEQ ID NO: 412; a VL of SEQ ID NO: 405 and a VH of SEQ ID NO: 413.

In one embodiment, the LukD antibody is a LukD antigen-binding fragment, i.e., a Fab, comprising the heavy chain variable region (VH) and first heavy chain constant domain (CH1) of an antibody coupled to the light chain variable region (VL) and light chain constant region (CL) of the antibody. In another embodiment, the LukD antibody is a F(ab')₂ fragment, which comprises both LukD antigen-binding fragments of the full-length antibody coupled by the hinge region. Heavy chain and light chain portions of exemplary LukD Fab fragments are provided in Table 9B below. Exemplary LukD Fab or F(ab')₂ fragments comprise a HC region of SEQ ID NO: 1304 and a LC region OF SEQ ID NO: 1306 (SM1B225); a HC region of SEQ ID NO: 1305 and a LC region of SEQ ID NO: 1307 (SM1B221).

TABLE 9B

LukD Fab Amino Acid Heavy Chain (HC) and Light Chain (LC) Sequences

| Protein AA ID | Fab of | Region | Fab Amino Acid Sequence | SEQ ID NO: |
|---|---|---|---|---|
| SM1B434 | SM1B225 | HC | EVQLQQSGGGLVKPGGSLKLSCAASGFTFSSYAMSWV RQTPEKRLEWVATITGGGTYTYYLDSVKGRFTISRDN AKTSLYLQMSSLRSEDTAMYYCARHRDGNYGCFDVWG AGTTVTVSSASTKGPSVFPLAPSSKSTSGGTAALGCL VKDYFPEPVTVSWNSGALTSGVHTFPAVLQSSGLYSL SSVVTVPSSSLGTQTYICNVNHKPSNTKVDKKVEPKS CHHHHHH | 1304 |
| SM1B790 | SM1B221 | HC | QVQLQQSGAELVMPGASVKMSCKASGYTFTDYWMHWV KQRPGQGLEWIGAIDTSDSYTSYNQKFKGKATLTVDE SSSTAYMQLSSLTSEDSAVYYCARDYGYAMDYWGQGT SVTVSSASTKGPSVFPLAPSSKSTSGGTAALGCLVKD YFPEPVTVSWNSGALTSGVHTFPAVLQSSGLYSLSSV VTVPSSSLGTQTYICNVNHKPSNTKVDKKVEPKSCHH HHHH | 1305 |
| SM1B434 | SM1B225 | LC | DIVLTQSPAIMSASLGERVTMTCTASSSVSSSYLHWY QQKPGSSPKLWVYSTSNLASGVPARFSGSGSGSSYSL TISSMEPEDTATYYCHQYHRSPQTFGGGTKLEIKRTV AAPSVFIFPPSDEQLKSGTASVVCLLNNFYPREAKVQ WKVDNALQSGNSQESVTEQDSKDSTYSLSSTLTLSKA DYEKHKVYACEVTHQGLSSPVTKSFNRGEC | 1306 |
| SM1B790 | SM1B221 | LC | QIVLTQSPAIIVISASPGEKVTITCSASLSVSYMHWF QQKPGTSPKLWIYSASNLASGVPARFSGSGSGTSYSL TISRMEAEDAATYYCQQRSSYPFTFGSGTKLEIKRTV AAPSVFIFPPSDEQLKSGTASVVCLLNNFYPREAKVQ WKVDNALQSGNSQESVTEQDSKDSTYSLSSTLTLSKA DYEKHKVYACEVTHQGLSSPVTKSFNRGEC | 1307 |

In another embodiment, the LukAB Fab or F(ab')₂ fragments as disclosed above comprise a heavy chain region having an amino acid sequence that shares at least 60%, at least 65%, at least 70%, at least 75%, at least 80%, at least 85%, at least 90%, at least 91%, at least 92%, at least 93%, at least 94% at least 95%, at least 96%, at least 97%, at least 98%, at least 99% sequence identity to any one of SEQ ID NOs: 1304-1305 as shown in Table 9B, and/or a light chain region having an amino acid sequence that shares at least 60%, at least 65%, at least 70%, at least 75%, at least 80%, at least 85%, at least 90%, at least 91%, at least 92%, at least 93%, at least 94% at least 95%, at least 96%, at least 97%, at least 98%, at least 99% sequence identity to any one of SEQ ID NOs: 1306-1307 as shown in Table 9B. Additional LukD Fab or F(ab')2 fragments of the present disclosure include those derived from the full-length LukD light chain and heavy chain sequences disclosed in Table 21 below (i.e., full length LukD light chain sequences of SEQ ID NO: 414-421 and heavy chain sequences of SEQ ID NOs: 422-429).

Exemplary LukD antibodies of the present disclosure comprising the VL and VH chains as enumerated above are provided in Table 21 by their respective full-length LC and HC sequences. In particular, the amino acid sequences of the full-length light chain corresponding to and comprising the VL of SEQ ID NOs: 398-405 are provided as SEQ ID NO: 414-421 in Table 21, respectfully. The amino acid sequences of the full-length heavy chains corresponding to and comprising the VH of SEQ ID NOs: 406-413 are provided as SEQ ID NOs: 422-429 in Table 21, respectively.

Another aspect of the present disclosure relates to an antibody or binding portion thereof that competes for leukocidin D binding with a monoclonal LukD antibody as described herein. In particular the disclosure herein encompasses antibodies and binding portions thereof that compete for LukD binding with a monoclonal antibody having (i) a heavy chain variable region comprising the CDR-H1 of SEQ ID NO: 373, the CDR-H2 of SEQ ID NO: 378, and the CDR-H3 of SEQ ID NO: 382, and a light chain variable region comprising the CDR-L1 of SEQ ID NO: 387, the CDR-L2 of SEQ ID NO: 390, and the CDR-L3 of SEQ ID NO: 395; (ii) a heavy chain variable region comprising the CDR-H1 of SEQ ID NO: 372, the CDR-H2 of SEQ ID NO: 375, and the CDR-H3 of SEQ ID NO: 380, and a light chain variable region comprising the CDR-L1 of SEQ ID NO: 386, the CDR-L2 of SEQ ID NO: 388, and the CDR-L3 of SEQ ID NO: 396; (iii) a heavy chain variable region comprising the CDR-H1 of SEQ ID NO: 374, the CDR-H2 of SEQ ID NO: 379, and the CDR-H3 of SEQ ID NO: 383, and a light chain variable region comprising the CDR-L1 of SEQ ID NO: 386, the CDR-L2 of SEQ ID NO: 391, and the CDR-L3 of SEQ ID NO: 397; or (iv) a heavy chain variable region comprising the CDR-H1 of SEQ ID NO: 372, the CDR-H2 of SEQ ID NO: 375, and the CDR-H3 of SEQ ID NO: 380, and a light chain variable region comprising the CDR-L1 of SEQ ID NO: 386, the CDR-L2 of SEQ ID NO: 388, and the CDR-L3 of SEQ ID NO: 392.

In accordance with this aspect of the disclosure, a competitive binding assay, such as BLI as described infra in Examples 2 and 3 can be utilized to identify a LukD antibody or binding portion thereof that competes for LukD binding with the enumerated monoclonal antibodies. Other competitive binding assays known in the art can also be utilized to identify a LukD antibody in accordance with this aspect of the disclosure.

Another aspect of the present disclosure is directed to antibodies or binding portions thereof that bind *Staphylococcus aureus* gamma-hemolysin A (HlgA). HlgA is another member of the *S. aureus* bi-component toxin family. HlgA, an S-class subunit, functions in conjunction with its partner, HlgB, an F-class subunit, to target and lyse host erythrocytes during *S. aureus* infection. In one embodiment, HlgA antibodies or binding portions thereof as described herein bind a HlgA protein having the amino acid sequence of SEQ ID NO: 832 (which corresponds to the native HlgA amino acid sequence containing a poly-histidine tag at the N-terminus to facilitate purification), native HlgA, or fragments or homologs thereof. The HlgA antibody or binding portion thereof binds HlgA with a Kd less than or equal to about $10^{-6}$, $10^{-7}$, $10^{-8}$, $10^{-9}$, $10^{-10}$, $10^{-11}$ or $10^{-12}$ M. In one embodiment, the HlgA antibody is a neutralizing antibody, i.e., it neutralizes or prevents the cytolytic activity of HlgAB on its target host cells. Neutralizing HlgA antibodies neutralize HlgAB cytolytic activity by binding to an epitope within regions of the HlgA protein involved in HlgA and HlgB protein-protein interaction or involved in HlgAB binding to its cognitive receptor on target cells (e.g., DARC)

An HlgA antibody or binding portion thereof as described herein comprises a heavy chain variable region that comprises: a complementarity-determining region 1 (CDR-H1) comprising an amino acid sequence of any one of SEQ ID NOs: 430-432, or a modified amino acid sequence of any one of SEQ ID NOs: 430-432, said modified sequence having at least 80% sequence identity to any one of SEQ ID NOs: 430-432; a complementarity-determining region 2 (CDR-H2) comprising an amino acid sequence of any one of SEQ ID NOs: 433-435, or a modified amino acid sequence of any one of SEQ ID NOs: 433-435, said modified sequence having at least 80% sequence identity to any one of SEQ ID NOs: 433-435; and a complementarity-determining region 3 (CDR-H3) comprising an amino acid sequence of any one of SEQ ID NOs: 436-438, or a modified amino acid sequence of any one of SEQ ID NO: 436-438, said modified sequence having at least 80% sequence identity to any one of SEQ ID NOs: 436-438. The HlgA antibody heavy chain CDR1, CDR2 and CDR3 amino acid sequences are provided in Table 10 below.

TABLE 10

HlgA Antibody Heavy Chain CDRs

| mAb/Fab name | VH name | HCDR1 Sequence | SEQ ID NO: | HCDR2 Sequence | SEQ ID NO: | HCDR3 Sequence | SEQ ID NO: |
|---|---|---|---|---|---|---|---|
| SM1B215 | HLGH2 | GYTFTIY | 430 | NTYTGE | 433 | CYYKYEDYAMD | 436 |
| SM1B216 | HLGH1 | GFTFSSY | 431 | NGNGGS | 434 | HRADGPWFT | 437 |
| SM1B217 | SM1H116 | GFTFSNY | 432 | SRRGS | 435 | VYYDNPWFV | 438 |
| SM1B218 | SM1H121 | GYTFTIY | 430 | NTYTGE | 433 | CYYKYEDYAMD | 436 |

TABLE 10-continued

HlgA Antibody Heavy Chain CDRs

| | | HCDR1 | | HCDR2 | | HCDR3 | |
|---|---|---|---|---|---|---|---|
| mAb/Fab name | VH name | Sequence | SEQ ID NO: | Sequence | SEQ ID NO: | Sequence | SEQ ID NO: |
| SM1B219 | SM1H122 | GFTFSSY | 431 | NGNGGS | 434 | HRADGPWFT | 437 |
| SM1B220 | SM1H116 | GFTFSNY | 432 | SRRGS | 435 | VYYDNPWFV | 438 |

The HlgA antibody or binding portion thereof may further comprise a light chain variable region. Exemplary HlgA light chain variable regions comprise: a complementarity-determining region 1 (CDR-L1) having an amino acid sequence of any one of SEQ ID NOs: 439-440, or a modified amino acid sequence of any one of SEQ ID NO: 439-440, said modified sequence having at least 80% sequence identity to any one of SEQ ID NO: 439-440; a complementarity-determining region 2 (CDR-L2) having an amino acid sequence of any one of SEQ ID NOs: 441-443, or a modified amino acid sequence of any one of SEQ ID NO: 441-443, said modified sequence having at least 80% sequence identity to any one of SEQ ID NO: 441-443; and a complementarity-determining region 3 (CDR-L3) having an amino acid sequence of any one of SEQ ID NOs: 444-445 or a modified amino acid sequence of any one of SEQ ID NO: 444-445, said modified sequence having at least 80% sequence identity to any one of SEQ ID NO: 444-445. The HlgA antibody light chain CDR1, CDR2 and CDR3 amino acid sequences are provided in Table 11 below.

body or binding portion thereof comprises a heavy chain variable region comprising the CDR-H1 of SEQ ID NO: 431, the CDR-H2 of SEQ ID NO: 434, and the CDR-H3 of SEQ ID NO: 437. In another embodiment, the HlgA antibody or binding portion thereof comprises a heavy chain variable region comprising the CDR-H1 of SEQ ID NO: 432, the CDR-H2 of SEQ ID NO: 435, and the CDR-H3 of SEQ ID NO: 438.

In one embodiment, the HlgA antibody or binding portion thereof of the present disclosure comprises a light chain variable region, where the light chain variable region comprises the CDR-L1 of SEQ ID NO: 439, the CDR-L2 of SEQ ID NO: 441, and the CDR-L3 of SEQ ID NO: 444. In another embodiment, the HlgA antibody or binding portion thereof comprises a light chain variable region comprising the CDR-L1 of SEQ ID NO: 440, the CDR-L2 of SEQ ID NO: 442, and the CDR-L3 of SEQ ID NO: 445. In another embodiment, the HlgA antibody or binding portion thereof comprises a light chain variable region comprising the CDR-L1 of SEQ ID NO: 439, the CDR-L2 of SEQ ID NO: 443, and the CDR-L3 of SEQ ID NO: 444.

TABLE 11

HlgA Antibody Light Chain CDRs

| | | LCDR1 | | LCDR2 | | LCDR3 | |
|---|---|---|---|---|---|---|---|
| mAb/Fab name | VL name | Sequence | SEQ ID NO: | Sequence | SEQ ID NO: | Sequence | SEQ ID NO: |
| SM1B215 | HLGL2 | SQSLLDSDGKTY | 439 | VVS | 441 | GTHFPL | 444 |
| SM1B216 | HLGL1 | SEDIYIR | 440 | GAT | 442 | YWRTPL | 445 |
| SM1B217 | SM1L42 | SQSLLDSDGKTY | 439 | LVS | 443 | GTHFPL | 444 |
| SM1B218 | SM1L42 | SQSLLDSDGKTY | 439 | LVS | 443 | GTHFPL | 444 |
| SM1B219 | HLGL2 | SQSLLDSDGKTY | 439 | VVS | 441 | GTHFPL | 444 |
| SM1B220 | HLGL2 | SQSLLDSDGKTY | 439 | VVS | 441 | GTHFPL | 444 |

In one embodiment, the HlgA antibodies disclosed herein comprise the heavy chain CDRs of Table 10 and light chain CDRs of Table 11 or modified CDRs thereof. Encompassed by the present disclosure are CDRs of Table 10 and 11 containing 1, 2, 3, 4, 5, or more amino acid substitutions that maintain or enhance HlgA or HlgAB binding of the antibody. The resulting modified CDRs are at least 70%, at least 75%, at least 80%, at least 85%, at least 90%, at least 95% similar in sequence to the CDRs of Tables 10 and 11. Suitable amino acid modifications and insertion to the heavy chain CDR sequences of Table 10 and/or the light chain CDR sequences of Table 11 are described supra.

In one embodiment, the HlgA antibody or binding portion thereof of the present disclosure comprises a heavy chain variable region comprising the CDR-H1 of SEQ ID NO: 430, the CDR-H2 of SEQ ID NO: 433, and the CDR-H3 of SEQ ID NO: 436. In another embodiment, the HlgA anti- In another embodiment, the HlgA antibody or binding portion thereof comprises the heavy chain CDRs of SEQ ID NOs: 430, 433, and 436 together with the light chain CDRs of SEQ ID NOs: 439, 441, and 444; the heavy chain CDRs of SEQ ID NOs: 431, 434, and 437 together with the light chain CDRs of SEQ ID NOs: 440, 442, and 445; the heavy chain CDRs of SEQ ID NOs: 432, 435, and 438 together with the light chain CDRs of SEQ ID NOs: 439, 443, and 444; the heavy chain CDRs of SEQ ID NOs: 430, 433, and 436 together with the light chain CDRs of SEQ ID NOs: 439, 443, and 444; the heavy chain CDRs of SEQ ID NOs: 431, 434, and 437 together with the light chain CDRs of SEQ ID NOs: 439, 441, and 444; or the heavy chain CDRs of SEQ ID NOs: 432, 435, and 438 together with the light chain CDRs of SEQ ID NOs: 439, 441, and 444.

The HlgA antibody or binding portion thereof as described herein may comprise a variable light (VL) chain, a variable heavy (VH) chain, or a combination of a VL and VH chain. The VL chain of the HlgA antibody as disclosed herein may comprise an amino acid sequence selected from SEQ ID NOs: 446-451 or an amino acid sequence that is at least 80% identical to any one of the amino acid sequence selected from SEQ ID NOs: 446-451. The VH chain of the HlgA antibody as disclosed herein may comprise an amino acid sequence selected from SEQ ID NOs: 452-457 or an amino acid sequence that is at least 80% identical to any one of the amino acid sequence selected from SEQ ID NOs: 452-457. The amino acid sequences of the HlgA VL and VH chains are provided in Table 12 below.

TABLE 12

HlgA Antibody Variable Light (VL) and Variable Heavy (VH) Chain Sequences

| mAb/Fab name | Region | Name | Sequence | SEQ ID NO: |
|---|---|---|---|---|
| SM1B215 | VL | HLGL2 | DVVMTQTPLTLSVTIGQPASISCKSSQSLLDSDGKTYLNWL LQRPGQSPKRLIYVVSKLDSGVPDRFTGSGSGTDFTLKISR VEAEDLGVYYCWQGTEIFPLTFGAGTKLELK | 446 |
| SM1B216 | VL | HLGL1 | DVVMTQTPSSFSVSLGDGVTITCKASEDIYIRLAWYQQKPG NAPRLLIFGATSLETGVPSRFSGSGSGKDYTLSITSLQTED VATYYCQQYWRTPLTFGAGTKLELK | 447 |
| SM1B217 | VL | SM1L42 | DVVMTQTPLTLSVTIGQPASISCKSSQSLLDSDGKTYLNWL LQRPGQSPKRLIYLVSKLDSGVPDRFTGSGSGTDFTLKISR VEAEDLGVYYCWQGTEIFPLTFGAGTKLELK | 448 |
| SM1B218 | VL | SM1L42 | DVVMTQTPLTLSVTIGQPASISCKSSQSLLDSDGKTYLNWL LQRPGQSPKRLIYLVSKLDSGVPDRFTGSGSGTDFTLKISR VEAEDLGVYYCWQGTHFPLTFGAGTKLELK | 449 |
| SM1B219 | VL | HLGL2 | DVVMTQTPLTLSVTIGQPASISCKSSQSLLDSDGKTYLNWL LQRPGQSPKRLIYVVSKLDSGVPDRFTGSGSGTDFTLKISR VEAEDLGVYYCWQGTHFPLTFGAGTKLELK | 450 |
| SM1B220 | VL | HLGL2 | DVVMTQTPLTLSVTIGQPASISCKSSQSLLDSDGKTYLNWL LQRPGQSPKRLIYVVSKLDSGVPDRFTGSGSGTDFTLKISR VEAEDLGVYYCWQGTHFPLTFGAGTKLELK | 451 |
| SM1B215 | VH | HLGH2 | EVQLQQSGPELKKPGETVKISCKTSGYTFTIYGMNWMKQAP GKGLKWMGWINTYTGEPTYADDFKGRFAFSLETSASTAYLQ INNLKNEDTATYFCARCYYKYEDYAMDYWGQGTSVTVSS | 452 |
| SM1B216 | VH | SM1GH1 | EVKLVESGGGLVKPGGSLKLSCAASGFTFSSYAMSWVRQTP EKRLEWVAAINGNGGSTYYPDTVKDRFTISRDNAKNTLYLQ MSSLRSEDTALYYCARHRADGPWFTYWGQGTLVTVSA | 453 |
| SM1B217 | VH | SM1H116 | EVKLVESGGGLVKPGGSLKLSCAASGFTFSNYAMSWVRQTP EKRLEWVASISRRGSTYYPDSVKGRFTISRDNARNILYLQM SSLRSEDTALYYCATVYYDNPWFVYWGQGTLVTVSA | 454 |
| SM1B218 | VH | SM1H121 | QIQLVQSGPELKKPGETVKISCKTSGYTFTIYGMNWTKQAP GKGLKWMGWINTYTGEPTYADDFKGRFAFSLETSASTAYLQ INNLKNEDTATYFCARCYYKYEDYAMDYWGQGTSVTVSS | 455 |
| SM1B219 | VH | VM1H122 | DVKLVESGGGLVKPGGSLKLSCAASGFTFSSYAMSWVRQTP EKRLEWVAAINGNGGSTYYPDTVKDRFTISRDNAKNTLYLQ MSSLRSEDTALYYCARHRADGPWFTYWGQGTLVTVSA | 456 |
| SM1B220 | VH | SM1H116 | EVKLVESGGGLVKPGGSLKLSCAASGFTFSNYAMSWVRQTP EKRLEWVASISRRGSTYYPDSVKGRFTISRDNARNILYLQM SSLRSEDTALYYCATVYYDNPWFVYWGQGTLVTVSA | 457 |

In another embodiment, the HigA antibody or binding fragment thereof comprises a VH region having an amino acid sequence that shares at least 60%, at least 65%, at least 70%, at least 75%, at least 80%, at least 85%, at least 90%, at least 91%, at least 92%, at least 930 at least 94% at least 95%, at least 96%, at least 97%, at least 98%, at least 99% sequence identity to any one of SEQ ID NOs: 452-457 as shown in Table 12, and/or a VL region having an amino acid sequence that shares at least 60%, at least 65%, at least 70%, at least 75%, at least 80%, at least 85%, at least 90%, at least 91%, at least 92%, at least 93% at least 94% at least 95%, at least 96%, at least 97%, at least 98%, at least 99% sequence identity to any one of SEQ ID NOs: 446-451 as shown in Table 12.

In one embodiment, the antibody or binding fragment thereof of the present disclosure comprises a humanized VH variant of any one of SEQ ID NOs: 452-457 and/or a humanized VL variant of any one of SEQ ID NOs: 446-451, where the framework regions are humanized or replaced with human immunoglobulin framework sequences. The humanized framework regions are designed to be similar in length and sequence to the parental framework sequences within SEQ ID NOs: 446-457, respectively. In one embodiment, the humanized framework regions share 50%, 55%, 60%, 65%, 70%, 75%, 80%, 85%, 90%, 95% or more sequence identity to the framework regions of any one of SEQ ID NOs: 446-457, respectively. In another embodiment, the humanized framework regions are 60%, 65%, 70%, 75%, 80%, 85%, 90%, 95% or more similar in length to the framework regions of any one of SEQ ID NOs: 446-457, respectively. Humanized variants of the VH of any one of SEQ ID NOs: 452-457 and the VL of any one of SEQ ID NOs: 446-451 share at least 50%, at least 55%, at least 60%, at least 65%, at least 70%, at least 75%, at least 80%, at least 85%, at least 90%, at least 95% sequence identity along the entire length of SEQ ID NOs: 452-457 and SEQ ID NOs: 446-451, respectively.

Suitable HlgA antibodies as disclosed herein may comprise a VL of SEQ ID NO: 446 and a VH of SEQ ID NO: 452; a VL of SEQ ID NO: 447 and a VH of SEQ ID NO: 453; a VL of SEQ ID NO: 448 and a VH of SEQ ID NO: 454; a VL of SEQ ID NO: 449 and a VH of SEQ ID NO: 455; a VL of SEQ ID NO: 450 and a VH of SEQ ID NO: 456; or a VL of SEQ ID NO: 451 and a VH of SEQ ID NO: 457.

Exemplary HlgA antibodies of the present disclosure comprising the VL and VH chains as enumerated above are provided in Table 22 by their respective full-length LC and HC sequences. In particular, the amino acid sequences of the full-length light chain corresponding to and comprising the VL of SEQ ID NOs: 446-451 are provided as SEQ ID NO: 458-463 in Table 22, respectfully. The amino acid sequences of the full-length heavy chains corresponding to and comprising the VH of SEQ ID NOs: 452-457 are provided as SEQ ID NOs: 464-469 in Table 22, respectively.

In another embodiment, the HlgA antibody is a HlgA antigen-binding fragment, i.e., a Fab, comprising the heavy chain variable region (VH) and first heavy chain constant domain (CH1) of an antibody coupled to the light chain variable region (VL) and light chain constant region (CL) of the antibody. In another embodiment, the HlgA antibody is a F(ab')$_2$ fragment, which comprises both HlgA antigen-binding fragments of the full-length antibody coupled by the hinge region. The heavy chain and light chain portions of HlgA Fab fragments can readily be derived from the full-length HlgA light chain and heavy chain sequences disclosed in Table 22 below (i.e., full length HlgA light chain sequences of SEQ ID NO: 458-463 and heavy chain sequences of SEQ ID NOs: 464-469).

Another aspect of the present disclosure relates to an antibody or binding portion thereof that competes for HlgA binding with a monoclonal HlgA antibody disclosed herein. In particular, the disclosure encompasses an antibody or binding portion thereof that competes for binding to HlgA with a monoclonal antibody having heavy chain variable region comprising the CDR-H1 of SEQ ID NO: 432, the CDR-H2 of SEQ ID NO: 435, and the CDR-H3 of SEQ ID NO: 438 and a light chain variable region comprising the CDR-L1 of SEQ ID NO: 439, the CDR-L2 of SEQ ID NO: 441, and the CDR-L3 of SEQ ID NO: 444. In accordance with this aspect of the disclosure, a competitive binding assay, such as BLI as described infra in Examples 2 and 3 can be utilized to identify an HlgA antibody or binding portion thereof that competes for HlgA binding with the enumerated monoclonal antibody. Other competitive binding assays known in the art can also be utilized to identify an HlgA antibody in accordance with this aspect of the disclosure.

Another aspect of the present disclosure is directed to antibodies or binding portions thereof that bind *Staphylococcus aureus* gamma-hemolysin C (HlgC). HlgC is another S-class subunit toxin that, in conjunction with HlgB, targets and lyses host erythrocytes during *S. aureus* infection. In one embodiment, HlgC antibodies or binding portions thereof as described herein bind a HlgC protein having the amino acid sequence of SEQ ID NO: 833 (which corresponds to the native HlgC amino acid sequence containing a poly-histidine tag at the N-terminus to facilitate purification), native HlgC protein, or fragments or homologs thereof. The HlgC antibody or binding portion thereof binds HlgC with a Kd less than or equal to about $10^{-6}$, $10^{-7}$, $10^{-8}$, $10^{-9}$, $10^{-10}$, $10^{-11}$ or $10^{-12}$ M. In one embodiment, the HlgC antibody is a neutralizing antibody, i.e., it neutralizes or prevents the cytolytic activity of HlgCB on its target immune host cells. Neutralizing HlgC antibodies neutralize HlgCB cytolytic activity by binding to an epitope within regions of the HlgC protein involved in HlgC and HlgB protein-protein interaction or involved in HlgCB binding to its cognitive receptor on target immune cells.

A HlgC antibody or binding portion thereof of the present disclosure comprises a heavy chain variable region that comprises: a complementarity-determining region 1 (CDR-H1) comprising an amino acid sequence of SEQ ID NO: 470, or a modified amino acid sequence of SEQ ID NO: 470, said modified sequence having at least 80% sequence identity to SEQ ID NO: 470; a complementarity-determining region 2 (CDR-H2) comprising an amino acid sequence of SEQ ID NO: 471, or a modified amino acid sequence of SEQ ID NO: 471, said modified sequence having at least 80% sequence identity to SEQ ID NO: 471; and a complementarity-determining region 3 (CDR-H3) comprising an amino acid sequence of SEQ ID NO: 472 or a modified amino acid sequence of SEQ ID NO: 472, said modified sequence having at least 80% sequence identity to SEQ ID NO: 472. The HlgC antibody heavy chain CDR1, CDR2 and CDR3 amino acid sequences are provided in Table 13 below.

TABLE 13

HlgC Antibody Heavy Chain CDRs

| mAb/Fab name | VH name | HCDR1 Sequence | SEQ ID NO: | HCDR2 Sequence | SEQ ID NO: | HCDR3 Sequence | SEQ ID NO: |
|---|---|---|---|---|---|---|---|
| SM1B202 | SM1H117 | GFTFSNY | 470 | SRRGS | 471 | VYYDNPWFV | 472 |
| SM1B203 | SM1H115 | GFTFSNY | 470 | SRRGS | 471 | VYYDNPWFV | 472 |
| SM1B204 | SM1H116 | GFTFSNY | 470 | SRRGS | 471 | VYYDNPWFV | 472 |
| SM1B205 | SM1H116 | GFTFSNY | 470 | SRRGS | 471 | VYYDNPWFV | 472 |
| SM1B206 | SM1H116 | GFTFSNY | 470 | SRRGS | 471 | VYYDNPWFV | 472 |
| SM1B207 | SM1H115 | GFTFSNY | 470 | SRRGS | 471 | VYYDNPWFV | 472 |

The HlgC antibody or binding portion thereof may further comprise a light chain variable region. Exemplary HlgC light chain variable regions comprise a complementarity-determining region 1 (CDR-L1) having an amino acid sequence of any one of SEQ ID NOs: 473-477, or a modified amino acid sequence of any one of SEQ ID NO: 473-477, said modified sequence having at least 80% sequence identity to any one of SEQ ID NO: 473-477; a complementarity-determining region 2 (CDR-L2) having an amino acid sequence of any one of SEQ ID NOs: 478-482, or a modified amino acid sequence of any one of SEQ ID NO: 478-482, said modified sequence having at least 80% sequence identity to any one of SEQ ID NO: 478-482; and a complementarity-determining region 3 (CDR-L3) having an amino acid sequence of any one of SEQ ID NOs: 483-487, or a modified amino acid sequence of any one of SEQ ID NO: 483-487, said modified sequence having at least 80% sequence identity to any one of SEQ ID NO: 483-487. The HlgC antibody light chain CDR1, CDR2 and CDR3 amino acid sequences are provided in Table 14 below.

binding portion thereof comprises a light chain variable region comprising the CDR-L1 of SEQ ID NO: 475, the CDR-L2 of SEQ ID NO: 480, and the CDR-L3 of SEQ ID NO: 485. In another embodiment, the HlgC antibody or binding portion thereof comprises a light chain variable region comprising the CDR-L1 of SEQ ID NO: 476, the CDR-L2 of SEQ ID NO: 481, and the CDR-L3 of SEQ ID NO: 486. In another embodiment, the HlgC antibody or binding portion thereof comprises a light chain variable region comprising the CDR-L1 of SEQ ID NO: 474, the CDR-L2 of SEQ ID NO: 482, and the CDR-L3 of SEQ ID NO: 487. In another embodiment, the HlgC antibody or binding portion thereof comprises a light chain variable region comprising the CDR-L1 of SEQ ID NO: 477, the CDR-L2 of SEQ ID NO: 480, and the CDR-L3 of SEQ ID NO: 485.

In another embodiment, the HlgC antibody or binding portion thereof comprises the heavy chain CDRs of SEQ ID NOs: 470, 471, and 472 together with the light chain CDRs of SEQ ID NOs: 473, 478, and 483; the heavy chain CDRs

TABLE 14

HlgC Antibody Light Chain CDRs

| mAb/Fab name | VH name | LCDR1 Sequence | SEQ ID NO: | LCDR2 Sequence | SEQ ID NO: | LCDR3 Sequence | SEQ ID NO: |
|---|---|---|---|---|---|---|---|
| SM1B202 | SM1L37 | STDIDDD | 473 | EGN | 478 | SDNMPY | 483 |
| SM1B203 | VSTL368 | SQSISDY | 474 | YDS | 479 | GHRFPF | 484 |
| SM1B204 | SM1L36 | SQSVLYSSNQKNY | 475 | WAS | 480 | YLSSY | 485 |
| SM1B205 | SM1L35 | SKSVSTSGYSY | 476 | LVS | 481 | IRELT | 486 |
| SM1B206 | DARL5 | SQSISDY | 474 | YAS | 482 | GHSFPL | 487 |
| SM1B207 | SM1L34 | SESVSFAGTSL | 477 | WAS | 480 | YLSSY | 485 |

The HlgC antibodies disclosed herein comprise the heavy chain CDRs of Table 13 and light chain CDRs of Table 14 or modified CDRs thereof. Encompassed by the present disclosure are CDRs of Table 13 and 14 containing 1, 2, 3, 4, 5, or more amino acid substitutions that maintain or enhance HlgC or HlgCB binding of the antibody. The resulting modified CDRs are at least 70%, at least 75%, at least 80%, at least 85%, at least 90%, at least 95% similar in sequence to the CDRs of Tables 13 and 14. Suitable amino acid modifications and insertion to the heavy chain CDR sequences of Table 13 and/or the light chain CDR sequences of Table 14 are described supra.

In one embodiment, the HlgC antibody or binding portion thereof of the present disclosure comprises a light chain variable region comprising the CDR-L1 of SEQ ID NO: 473 the CDR-L2 of SEQ ID NO: 478, and the CDR-L3 of SEQ ID NO: 483. In another embodiment, the HlgC antibody or binding portion thereof comprises a light chain variable region comprising the CDR-L1 of SEQ ID NO: 474, the CDR-L2 of SEQ ID NO: 479, and the CDR-L3 of SEQ ID NO: 484. In another embodiment, the HlgC antibody or of SEQ ID NOs: 470, 471, and 472 together with the light chain CDRs of SEQ ID NOs: 474, 479 and 484; the heavy chain CDRs of SEQ ID NOs: 470, 471, and 472 together with the light chain CDRs of SEQ ID NOs: 475, 480, and 485; the heavy chain CDRs of SEQ ID NOs: 470, 471, and 472 together with the light chain CDRs of SEQ ID NOs: 476, 481, and 486; the heavy chain CDRs of SEQ ID NOs: 470, 471, and 472 together with the light chain CDRs of SEQ ID NOs: 474, 482, and 487; the heavy chain CDRs of SEQ ID NOs: 470, 471, and 472 together with the light chain CDRs of SEQ ID NOs: 477, 480, and 485.

The HlgC antibody or binding portion thereof as described herein may comprises a variable light (VL) chain, a variable heavy (VH) chain, or a combination of a VL and VH chain. The VL chain of the HlgC antibody as disclosed herein may comprise an amino acid sequence selected from SEQ ID NOs: 488-493 or an amino acid sequence that is at least 80% identical to any one of the amino acid sequence selected from SEQ ID NOs: 488-493. The VH chain of the HlgC antibody as disclosed herein may comprise an amino acid sequence selected from SEQ ID NOs: 494-499 or an amino acid sequence that is at least 80% identical to any one of the amino acid sequence selected from SEQ ID NOs: 494-499. The amino acid sequences of the HlgC VL and VH chains are provided in Table 15 below.

TABLE 15

HlgC Antibody Variable Light (VL) and
Variable Heavy (VH) Chain Sequences

| mAb/Fam name | Region | Name | Sequence | SEQ ID NO: |
|---|---|---|---|---|
| SM1B202 | VL | SM1L37 | ETTVTQSPASLSVATGEKVTIRCITSTDIDDDMSWYQQKP GEPPKLLISEGNTLRPGVPSRFSSSGCGTDFVFTIENTLS EDVADYYCLQSDNMPYTFGGGTKLEIK | 488 |
| SM1B203 | VL | VSTL368 | DIVMTQSPATLSVTPGDRVSLSCRASQSISDYLHWYQQKS HESPRLLIKYDSQSISGIPSRFSGSGSGSDFTLSINSVEP EDVGVYYCQNGERFPFTFGGGTKLEIK | 489 |
| SM1B204 | VL | SM1L36 | NIMMTQSPSSLTVSAGEKVTMSCKSSQSVLYSSNQKNYLA WYQQKPGQSPKLLIYWASTRESGVPDRFAGSGSGTDFTLS ISSVQAEDLAVYYCHQYLSSYTFGGGTKLEIK | 490 |
| SM1B205 | VL | SM1L35 | DIVLTQSPASLAVSLGQRATISYRASKSVSTSGYSYMETW NQQKPGQPPRLLIYLVSNLESGVPARFSGSGSGTDFTLNI HPVEEEDAATYYCQHIRELTRSEGGTKLEIK | 491 |
| SM1B206 | VL | DARL5 | DIVMTQSPATLSVTPGDRVSLSCRASQSISDYLHWYQQKS HESPRLLIKYASQSISGIPSRFSGSGSGSDFTLSINSVEP EDVGVYYCQNGHSFPLTFGAGTKLELK | 492 |
| SM1B207 | VL | SM1L34 | DIVLTQSPASLAVSLGQRATISCQASESVSFAGTSLMHWY QQKPGQSPKLLIYWASTRESGVPDRFAGSGSGTDFTLSIS SVQAEDLAVYYCHQYLSSYTFGGGTKLEIK | 493 |
| SM1B202 | VH | SM1H117 | EVMLVESGGGLVKPGGSLKLSCAASGFTFSNYAMSWVRQT PEKRLEWVASISRRGSTYYPDSGKGRFTISRDNARNIPYL QMSSLRSEDTALYYCATVYYDNPWFVYWGQGTLVTVSA | 494 |
| SM1B203 | VH | SM1H115 | EVMLVESGGGLVKPGGSLKLSCAASGFTFSNYAMSWVRQT PEKRLEWVASISRRGSTYYPDSVKGRFTISRDNARNILYL QMSSLRSEDTALYYCATVYYDNPWFVYWGQGTLVTVSA | 495 |
| SM1B204 | VH | SM1H116 | EVKLVESGGGLVKPGGSLKLSCAASGFTFSNYAMSWVRQT PEKRLEWVASISRRGSTYYPDSVKGRFTISRDNARNILYL QMSSLRSEDTALYYCATVYYDNPWFVYWGQGTLVTVSA | 496 |
| SM1B205 | VH | SM1H116 | EVKLVESGGGLVKPGGSLKLSCAASGFTFSNYAMSWVRQT PEKRLEWVASISRRGSTYYPDSVKGRFTISRDNARNILYL QMSSLRSEDTALYYCATVYYDNPWFVYWGQGTLVTVSA | 497 |
| SM1B206 | VH | SM1H116 | EVKLVESGGGLVKPGGSLKLSCAASGFTFSNYAMSWVRQT PEKRLEWVASISRRGSTYYPDSVKGRFTISRDNARNILYL QMSSLRSEDTALYYCATVYYDNPWFVYWGQGTLVTVSA | 498 |
| SM1B207 | VH | SM1H115 | EVMLVESGGGLVKPGGSLKLSCAASGFTFSNYAMSWVRQT PEKRLEWVASISRRGSTYYPDSVKGRFTISRDNARNILYL QMSSLRSEDTALYYCATVYYDNPWFVYWGQGTLVTVSA | 499 |

In another embodiment, the antibody or binding fragment thereof comprises a VH region having an amino acid sequence that shares at least 60%, at least 65%, at least 70%, at least 75%, at least 80%, at least 85%, at least 90%, at least 91%, at least 92%, at least 93%, at least 94% at least 95%, at least 96%, at least 97%, at least 98%, at least 99% sequence identity to any one of SEQ ID NOs: 494-499 as shown in Table 15, and/or a VL region having an amino acid sequence that shares at least 60%, at least 65%, at least 70%, at least 750, at least 80%, at least 85%, at least 90%, at least 91%, at least 92%, at least 93% at least 94% at least 95% at least 96%, at least 97%, at least 98%, at least 99% sequence identity to any one of SEQ ID NOs: 488-493 as shown in Table 15.

In one embodiment, the antibody or binding fragment thereof of the present disclosure comprises a humanized VH variant of any one of SEQ ID NOs: 494-499 and/or a humanized VL variant of any one of SEQ ID NOs: 488-493, where the framework regions are humanized or replaced with human immunoglobulin framework sequences. The humanized framework regions are designed to be similar in length and sequence to the parental framework sequences within SEQ ID NOs: 488-499, respectively. In one embodiment, the humanized framework regions share 50%, 55%, 60%, 65%, 70%, 75%, 80%, 85%, 90%, 95% or more sequence identity to the framework regions of any one of SEQ ID NOs: 488-499, respectively. In another embodiment, the humanized framework regions are 60%, 65%, 70%, 75%, 80%, 85%, 90%, 95% or more similar in length to the framework regions of any one of SEQ ID NOs: 488-499, respectively. Humanized variants of the VH of any one of SEQ ID NOs: 494-499 and the VL of any one of SEQ ID NOs: 488-493 share at least 50%, at least 55%, at least 60%, at least 65%, at least 70%, at least 75%, at least 80%, at least 85%, at least 90%, at least 95% sequence identity along the entire length of SEQ ID NOs: 494-499 and SEQ ID NOs: 488-493, respectively.

Suitable HlgC antibodies as disclosed herein comprise a VL of SEQ ID NO: 488 and a VH of SEQ ID NO: 494; a VL of SEQ ID NO: 489 and a VH of SEQ ID NO: 495; a VL of SEQ ID NO: 490 and a VH of SEQ ID NO: 496; a VL of SEQ ID NO: 491 and a VH of SEQ ID NO:497; a VL of SEQ ID NO: 492 and a VH of SEQ ID NO: 498; or a VL of SEQ ID NO: 493 and a VH of SEQ ID NO: 499.

Exemplary HlgC antibodies of the present disclosure comprising the VL and VH chains as enumerated above are provided in Table 23 by their respective full-length LC and HC sequences. In particular, the amino acid sequences of the full-length light chain corresponding to and comprising the VL of SEQ ID NOs: 488-493 are provided as SEQ ID NO: 500-505 in Table 23, respectfully. The amino acid sequences of the full-length heavy chains corresponding to and comprising the VH of SEQ ID NOs: 494-499 are provided as SEQ ID NOs: 506-511 in Table 23, respectively.

In another embodiment, the HlgC antibody is a HlgC antigen-binding fragment, i.e., a Fab, comprising the heavy chain variable region (VH) and first heavy chain constant domain (CH1) of an antibody coupled to the light chain variable region (VL) and light chain constant region (CL) of the antibody. In another embodiment, the HlgC antibody is a F(ab')$_2$ fragment, which comprises both HlgC antigen-binding fragments of the full-length antibody coupled by the hinge region. The heavy chain and light chain portions of HlgC Fab fragments can readily be derived from the full-length HlgC light chain and heavy chain sequences disclosed in Table 23 below (i.e., full length HlgC light chain sequences of SEQ ID NO: 500-505 and heavy chain sequences of SEQ ID NOs: 506-511).

Another aspect of the present disclosure is directed to an antibody or binding portion thereof that competes for HlgC binding to a monoclonal antibody as described herein. In particular, the present disclosure encompasses an antibody or binding fragment thereof that competes for HlgC binding with a monoclonal antibody having a heavy chain variable region comprising the CDR-H1 of SEQ ID NO: 470, the CDR-H2 of SEQ ID NO: 471, and the CDR-H3 of SEQ ID NO: 472 and a light chain variable region comprising the CDR-L1 of SEQ ID NO: 474, the CDR-L2 of SEQ ID NO: 479, and the CDR-L3 of SEQ ID NO: 484. In accordance with this aspect of the disclosure, a competitive binding assay, such as BLI as described infra in Examples 2 and 3 can be utilized to identify an HlgC antibody or binding portion thereof that competes for HlgC binding with the enumerated monoclonal antibody. Other competitive binding assays known in the art can also be utilized to identify an HlgC antibody in accordance with this aspect of the disclosure.

Another aspect of the present disclosure relates to antibodies or binding portions thereof that bind *Staphylococcus aureus* LukE and/or HlgA. In one embodiment, LukE/HlgA antibodies or binding portions thereof as described herein bind a LukE protein having the amino acid sequence of SEQ ID NO: 826 and/or an HlgA protein having the amino acid sequence of SEQ ID NO: 832 including native LukE and HlgA proteins, fragments, and/or homologs thereof. The LukE/HlgA antibody or binding portion thereof binds LukE and/or HlgA with a Kd less than or equal to about $10^{-6}$, $10^{-7}$, $10^{-8}$, $10^{-9}$, $10^{-10}$, $10^{-11}$ or $10^{-12}$ M. In one embodiment, the LukE/HlgA antibody is a neutralizing antibody, i.e., it neutralizes or prevents the cytolytic activity of LukED on its target immune host cells. Neutralizing LukE antibodies neutralize LukED cytolytic activity by binding to and inhibiting LukE and LukD protein-protein interaction or by inhibiting LukED binding to its cognitive receptor on target immune cells.

A LukE and/or HlgA antibody or binding portion thereof of the present disclosure comprises a heavy chain variable region that comprises: a complementarity-determining region 1 (CDR-H1) comprising an amino acid sequence of any one of SEQ ID NOs: 513-529, or a modified amino acid sequence of any one of SEQ ID NOs: 513-529, said modified sequence having at least 80% sequence identity to any one of SEQ ID NOs: 513-529; a complementarity-determining region 2 (CDR-H2) comprising an amino acid sequence of any one of SEQ ID NOs: 530-548, or a modified amino acid sequence of any one of SEQ ID NOs: 530-548, said modified sequences having at least 80% sequence identity to any one of SEQ ID NOs: 530-548; and a complementarity-determining region 3 (CDR-H3) comprising an amino acid sequence of any one of SEQ ID NOs: 549-568 or a modified amino acid sequence of any one of SEQ ID NO: 549-568 said modified sequence having at least 80% sequence identity to any one of SEQ ID NOs: 549-568. The heavy chain CDR1, CDR2 and CDR3 amino acid sequences are provided in Table 16 below.

TABLE 16

LukE/HlgA Antibody Heavy Chain CDRs

| mAb/Fab name | VH name | HCDR1 Sequence | SEQ ID NO: | HCDR2 Sequence | SEQ ID NO: | HCDR3 Sequence | SEQ ID NO: |
|---|---|---|---|---|---|---|---|
| SM1B302 | HLGH3 | GFTFSSF | 513 | SRTDN | 530 | ADYDGPWFA | 549 |
| SM1B303 | HLGH4 | GYSFTGY | 514 | NPNNGG | 531 | DDYSFA | 550 |
| SM1B304 | HLGH5 | GFTFTDF | 515 | RNKANGYT | 532 | DVGDYD | 551 |
| SM1B305 | HLGH6 | GFTFTNY | 516 | NTYTGE | 533 | DYRDGDALD | 552 |
| SM1B306 | HLGH7 | GYSFTSN | 517 | HPSDSE | 534 | GDGGFA | 553 |
| SM1B307 | HLGH8 | GYSFTGY | 514 | NPYNGG | 535 | GYPRGWFA | 554 |
| SM1B308 | HLGH9 | GFTFRNH | 518 | NVNAGS | 536 | HRAYYNYDENAMD | 555 |
| SM1B309 | HLGH10 | GYTFTDY | 519 | YPNNGG | 537 | LTYYAKVD | 556 |
| SM1B310 | HLGH11 | GFTFSSY | 520 | NSNGGS | 538 | LYYGD | 557 |
| SM1B311 | HLGH12 | GFSLTTY | 521 | WRGGT | 539 | TD | 558 |
| SM1B312 | HLGH12 | GFSLTTY | 521 | WRGGT | 539 | TD | 558 |

TABLE 16-continued

LukE/HlgA Antibody Heavy Chain CDRs

| mAb/Fab name | VH name | HCDR1 Sequence | SEQ ID NO: | HCDR2 Sequence | SEQ ID NO: | HCDR3 Sequence | SEQ ID NO: |
|---|---|---|---|---|---|---|---|
| SM1B313 | HLGH12 | GFSLTTY | 521 | WRGGT | 539 | TD | 558 |
| SM1B314 | HLGH13 | GFSLTTY | 521 | WRGGT | 539 | TD | 558 |
| SM1B315 | HLGH14 | GFSLTTY | 521 | WRGGT | 539 | TD | 558 |
| SM1B316 | HLGH12 | GFSLTTY | 521 | WRGGT | 539 | TD | 558 |
| SM1B317 | HLGH15 | GFSLTSY | 522 | WSGGI | 540 | TD | 558 |
| SM1B318 | HLGH16 | GYKFSSY | 523 | LPGSGS | 541 | TISTATDWFA | 559 |
| SM1B319 | HLGH16 | GYKFSSY | 523 | LPGSGS | 541 | TISTATDWFA | 559 |
| SM1B320 | HLGH17 | GYKFSSY | 523 | LPGSGS | 541 | TISTATDWFA | 559 |
| SM1B321 | HLGH18 | GYKFSSY | 523 | LPGSGS | 541 | TISTATDWFA | 559 |
| SM1B322 | HLGH17 | GYKFSSY | 523 | LPGSGS | 541 | TISTATDWFA | 559 |
| SM1B323 | HLGH19 | GYKFSSY | 523 | LPGSGS | 541 | TISTATDWFA | 559 |
| SM1B324 | HLGH20 | GFNIKDY | 524 | DPENGN | 542 | YDGYAMD | 560 |
| SM1B325 | HLGH21 | GYTFTNY | 525 | YPGGGY | 543 | ND | 561 |
| SM1B326 | HLGH22 | GFSITSY | 526 | WSGGS | 544 | FYYDYDEGFD | 562 |
| SM1B327 | HLGH23 | GFSITSY | 526 | WSGGS | 544 | FYYDYDEGFD | 562 |
| SM1B328 | HLGH23 | GFSITSY | 526 | WSGGS | 544 | FYYDYDEGFD | 562 |
| SM1B329 | HLGH23 | GFSITSY | 526 | WSGGS | 544 | FYYDYDEGFD | 562 |
| SM1B330 | HLGH23 | GFSITSY | 526 | WSGGS | 544 | FYYDYDEGFD | 562 |
| SM1B331 | HLGH23 | GFSITSY | 526 | WSGGS | 544 | FYYDYDEGFD | 562 |
| SM1B332 | HLGH24 | GLSLTSY | 527 | WGDGS | 545 | RGDYGSYAMD | 563 |
| SM1B333 | HLGH25 | GFNIKDS | 528 | DPEDGE | 546 | GGLILD | 564 |
| SM1B334 | HLGH26 | GYTFTNY | 525 | NTYTGE | 533 | DYREGDAMD | 565 |
| SM1B335 | HLGH27 | GFTFSSY | 520 | STSGSY | 547 | HGDHDGFD | 566 |
| SM1B336 | HLGH28 | GFSFSNY | 529 | NSGGSF | 548 | HWDHPWFA | 567 |
| SM1B337 | HLGH28 | GFSFSNY | 529 | NSGGSF | 548 | HWDHPWFA | 567 |
| SM1B338 | HLGH28 | GFSFSNY | 529 | NSGGSF | 548 | HWDHPWFA | 567 |
| SM1B339 | HLGH29 | GFNIKDS | 528 | DPEDGE | 546 | SFGV | 568 |
| SM1B340 | HLGH30 | GFNIKDS | 528 | DPEDGE | 546 | SFGV | 568 |

The LukE/HigA antibody or binding portion thereof may further comprise a light chain variable region. Exemplary light chain variable regions comprise a complementarity-determining region 1 (CDR-L1) having an amino acid sequence of any one of SEQ ID NOs: 569-600, or a modified amino acid sequence of any one of SEQ ID NO:569-600, said modified sequence having at least 80% sequence identity to any one of SEQ ID NO: 569-600; a complementarity-determining region 2 (CDR-L2) having an amino acid sequence of any one of SEQ ID NOs:601-621, or a modified amino acid sequence of any one of SEQ ID NO: 601-621, said modified sequence having at least 80% sequence identity to any one of SEQ ID NO: 601-621; and a complementarity-determining region 3 (CDR-L3) having an amino acid sequence of any one of SEQ ID NOs: 622-654, or a modified amino acid sequence of any one of SEQ ID NO: 622-654, said having at least 80% sequence identity to any one of SEQ ID NO: 622-654. The light chain CDR1, CDR2 and CDR3 amino acid sequences are provided in Table 17 below.

TABLE 17

LukE/HlgA Light Chain CDRs

| mAb/Fab name | VH name | LCDR1 Sequence | SEQ ID NO: | LCDR2 Sequence | SEQ ID NO: | LCDR3 Sequence | SEQ ID NO: |
|---|---|---|---|---|---|---|---|
| SM1B302 | C47L104 | SQDIGSS | 569 | ATS | 601 | YASSPW | 622 |
| SM1B303 | HLGL3 | SQDIRSY | 570 | YTS | 602 | GNTLPY | 623 |
| SM1B304 | HLGL4 | SQEISGY | 571 | AAS | 603 | YASYPR | 624 |
| SM1B305 | HLGL5 | SQIIVHSNGNTY | 572 | KIS | 604 | GSHVPW | 625 |
| SM1B306 | HLGL6 | SQSLANSYGNTY | 573 | GIS | 605 | GTHQPP | 626 |
| SM1B307 | HLGL7 | SESVDSYGNSF | 574 | RAS | 606 | SNEDPPW | 627 |
| SM1B308 | HLGL8 | SQSLLNSRTRKNY | 575 | WAS | 607 | SYNLW | 628 |
| SM1B309 | HLGL9 | SQSLLHSNGKTY | 576 | KVS | 608 | STHVPL | 629 |
| SM1B310 | HLGL10 | SQDVSAA | 577 | WAS | 607 | HYSTPG | 630 |
| SM1B311 | HLGL11 | SQTIVHSSGNTY | 578 | KVS | 608 | GSHVPY | 631 |
| SM1B312 | GC5L29 | SQGISNY | 579 | YTS | 602 | YSKLPF | 632 |
| SM1B313 | HLGL12 | SQSLLYSSNQKNY | 580 | WAS | 607 | YYSYPY | 633 |
| SM1B314 | OSML437 | SENIYSN | 581 | AAT | 609 | FWGTPY | 634 |
| SM1B315 | TM3L53 | SQDINSY | 582 | RAN | 610 | YDEFPY | 635 |
| SM1B316 | HLGL13 | SQGISNY | 579 | YTS | 602 | YSKLPW | 636 |
| SM1B317 | HLGL14 | SQTIVYSDGNTY | 583 | KVS | 608 | GSHVPY | 631 |
| SM1B318 | HLGL14 | SQTIVYSDGNTY | 584 | KVS | 608 | GSHVPY | 631 |
| SM1B319 | HLGL15 | SKSLLHSNGNTY | 585 | RMS | 611 | HLEYPF | 637 |
| SM1B320 | ATCL1 | SQGISNY | 579 | YTS | 602 | YSKLPY | 638 |
| SM1B321 | VSTL360 | SENIYSY | 586 | NAK | 612 | HYGSPY | 639 |
| SM1B322 | ATCL3 | SQDVSTA | 587 | SAS | 613 | HYSTPW | 640 |
| SM1B323 | HLGL16 | STDIDDD | 588 | EGN | 614 | SDNLPY | 641 |
| SM1B324 | HLGL17 | SQSLLNSGNQKNY | 589 | GAS | 615 | DHSYPP | 642 |
| SM1B325 | HLGL18 | SQDIGNS | 590 | ATS | 601 | FASSPL | 643 |
| SM1B326 | OSML437 | SENIYSN | 581 | AAT | 609 | FWGTPY | 634 |
| SM1B327 | HLGL19 | SSNVSY | 591 | DTS | 616 | WSSNPR | 644 |
| SM1B328 | VSTL342 | SQDIGSY | 592 | ATS | 601 | YATSPW | 645 |
| SM1B329 | HLGL20 | SDHINNW | 593 | GAT | 617 | YWSTPY | 646 |
| SM1B330 | HLGL21 | SSSVSY | 594 | YAS | 618 | WSSNPPI | 647 |
| SM1B331 | VSTL368 | SQSISDY | 595 | YDS | 619 | GHRFPF | 648 |
| SM1B332 | HLGL22 | SSSVSSSY | 596 | STS | 620 | WSSYPP | 649 |
| SM1B333 | HLGL23 | SESVDSYGNSF | 574 | LAS | 621 | NNEDPY | 650 |
| SM1B334 | HLGL24 | SQSIVYSNGNTY | 597 | KVS | 608 | GSHVPW | 625 |
| SM1B335 | HLGL25 | SQSLANSYGNTY | 573 | GIS | 605 | GTHQPY | 651 |
| SM1B336 | HLGL26 | SQSVLYNSNQRNY | 598 | WAS | 607 | YLSSY | 652 |
| SM1B337 | HLGL27 | SQDVGTA | 599 | WAS | 607 | YSSYPL | 653 |
| SM1B338 | HLGL7 | SESVDSYGNSF | 574 | RAS | 606 | SNEDPPW | 627 |

TABLE 17-continued

LukE/HlgA Light Chain CDRs

| mAb/Fab name | VH name | LCDR1 Sequence | SEQ ID NO: | LCDR2 Sequence | SEQ ID NO: | LCDR3 Sequence | SEQ ID NO: |
|---|---|---|---|---|---|---|---|
| SM1B339 | HLGL7 | SESVDSYGNSF | 574 | RAS | 606 | SNEDPPW | 627 |
| SM1B340 | HLGL28 | SQDIDNY | 600 | YTS | 602 | GYTLPW | 654 |

The LukE/HigA antibodies disclosed herein comprise the heavy chain CDRs of Table 16 and light chain CDRs of Table 17 or modified CDRs thereof. Encompassed by the present disclosure are CDRs of Table 16 and 17 containing 1, 2, 3, 4, 5, or more amino acid substitutions that maintain or enhance LukE or LukED binding of the antibody. The resulting modified CDRs are at least 70%, at least 75%, at least 80%, at least 85%, at least 90%, at least 95% similar in sequence to the CDRs of Tables 16 and 17. Suitable amino acid modifications and insertion to the heavy chain CDR sequences of Table 16 and/or the light chain CDR sequences of Table 17 are described supra.

In one embodiment, the LukE/HlgA antibody or binding portion thereof of the present disclosure comprises a heavy chain variable region comprising the CDR-H1 of SEQ ID NO: 513, the CDR-H2 of SEQ ID NO: 530, and the CDR-H3 of SEQ ID NO: 549. In another embodiment, the LukE/HlgA antibody or binding portion thereof comprises a heavy chain variable region comprising the CDR-H1 of SEQ ID NO: 514, the CDR-H2 of SEQ ID NO: 531, and the CDR-H3 of SEQ ID NO: 550. In another embodiment, the LukE/HlgA antibody or binding portion thereof comprises a heavy chain variable region comprising the CDR-H1 of SEQ ID NO: 515, the CDR-H2 of SEQ ID NO: 532, and the CDR-H3 of SEQ ID NO: 551. In another embodiment, the LukE/HlgA antibody or binding portion thereof comprises a heavy chain variable region comprising the CDR-H1 of SEQ ID NO: 516, the CDR-H2 of SEQ ID NO: 533, and the CDR-H3 of SEQ ID NO: 552. In another embodiment, the LukE/HlgA antibody or binding portion thereof comprises a heavy chain variable region comprising the CDR-H1 of SEQ ID NO: 517, the CDR-H2 of SEQ ID NO: 534, and the CDR-H3 of SEQ ID NO: 553. In another embodiment, the LukE/HlgA antibody or binding portion thereof comprises a heavy chain variable region comprising the CDR-H1 of SEQ ID NO: 514, the CDR-H2 of SEQ ID NO: 535, and the CDR-H3 of SEQ ID NO: 554. In another embodiment, the LukE/HlgA antibody or binding portion thereof comprises a heavy chain variable region comprising the CDR-H1 of SEQ ID NO: 518, the CDR-H2 of SEQ ID NO: 536, and the CDR-H3 of SEQ ID NO: 555. In another embodiment, the LukE/HlgA antibody or binding portion thereof comprises a heavy chain variable region comprising the CDR-H1 of SEQ ID NO: 519, the CDR-H2 of SEQ ID NO: 537, and the CDR-H3 of SEQ ID NO: 556. In another embodiment, the LukE/HlgA antibody or binding portion thereof comprises a heavy chain variable region comprising the CDR-H1 of SEQ ID NO: 520, the CDR-H2 of SEQ ID NO: 538, and the CDR-H3 of SEQ ID NO: 557. In another embodiment, the LukE/HlgA antibody or binding portion thereof comprises a heavy chain variable region comprising the CDR-H1 of SEQ ID NO: 521, the CDR-H2 of SEQ ID NO: 539, and the CDR-H3 of SEQ ID NO: 558. In another embodiment, the LukE/HlgA antibody or binding portion thereof comprises a heavy chain variable region comprising the CDR-H1 of SEQ ID NO: 522, the CDR-H2 of SEQ ID NO: 540, and the CDR-H3 of SEQ ID NO: 558. In another embodiment, the LukE/HlgA antibody or binding portion thereof comprises a heavy chain variable region comprising the CDR-H1 of SEQ ID NO: 523, the CDR-H2 of SEQ ID NO: 541, and the CDR-H3 of SEQ ID NO: 559. In another embodiment, the LukE/HlgA antibody or binding portion thereof comprises a heavy chain variable region comprising the CDR-H1 of SEQ ID NO: 524, the CDR-H2 of SEQ ID NO: 542, and the CDR-H3 of SEQ ID NO: 560. In another embodiment, the LukE/HlgA antibody or binding portion thereof comprises a heavy chain variable region comprising the CDR-H1 of SEQ ID NO: 525, the CDR-H2 of SEQ ID NO: 543, and the CDR-H3 of SEQ ID NO: 561. In another embodiment, the LukE/HlgA antibody or binding portion thereof comprises a heavy chain variable region comprising the CDR-H1 of SEQ ID NO: 526, the CDR-H2 of SEQ ID NO: 544, and the CDR-H3 of SEQ ID NO: 562. In another embodiment, the LukE/HlgA antibody or binding portion thereof comprises a heavy chain variable region comprising the CDR-H1 of SEQ ID NO: 527, the CDR-H2 of SEQ ID NO: 545, and the CDR-H3 of SEQ ID NO: 563. In another embodiment, the LukE/HlgA antibody or binding portion thereof comprises a heavy chain variable region comprising the CDR-H1 of SEQ ID NO: 528, the CDR-H2 of SEQ ID NO: 546, and the CDR-H3 of SEQ ID NO: 564. In another embodiment, the LukE/HlgA antibody or binding portion thereof comprises a heavy chain variable region comprising the CDR-H1 of SEQ ID NO: 525, the CDR-H2 of SEQ ID NO: 533, and the CDR-H3 of SEQ ID NO: 565. In another embodiment, the LukE/HlgA antibody or binding portion thereof comprises a heavy chain variable region comprising the CDR-H1 of SEQ ID NO: 520, the CDR-H2 of SEQ ID NO: 547, and the CDR-H3 of SEQ ID NO: 566. In another embodiment, the LukE/HlgA antibody or binding portion thereof comprises a heavy chain variable region comprising the CDR-H1 of SEQ ID NO: 529, the CDR-H2 of SEQ ID NO: 548, and the CDR-H3 of SEQ ID NO: 567. In another embodiment, the LukE/HlgA antibody or binding portion thereof comprises a heavy chain variable region comprising the CDR-H1 of SEQ ID NO: 528, the CDR-H2 of SEQ ID NO: 546, and the CDR-H3 of SEQ ID NO: 568.

In another embodiment, the LukE/HlgA antibody or binding portion thereof of the present disclosure comprises a light chain variable region comprising the CDR-L1 of SEQ ID NO: 569, the CDR-L2 of SEQ ID NO: 601, and the CDR-L3 of SEQ ID NO: 622. In another embodiment, the LukE/HlgA antibody or binding portion thereof comprises a light chain variable region comprising the CDR-L1 of SEQ ID NO: 570, the CDR-L2 of SEQ ID NO: 602, and the CDR-L3 of SEQ ID NO: 623. In another embodiment, the LukE/HgA antibody or binding portion thereof comprises a light chain variable region comprising the CDR-L1 of SEQ ID NO: 571, the CDR-L2 of SEQ ID NO: 603, and the CDR-L3 of SEQ ID NO: 624. In another embodiment, the LukE/HlgA antibody or binding portion thereof comprises a light chain variable region comprising the CDR-L1 of SEQ ID NO: 572, the CDR-L2 of SEQ ID NO:604, and the CDR-L3 of SEQ ID NO: 625. In another embodiment, the LukE/HlgA antibody or binding portion thereof comprises a light chain variable region comprising the CDR-L1 of SEQ ID NO: 573, the CDR-L2 of SEQ ID NO: 605, and the CDR-L3 of SEQ ID NO: 626. In another embodiment, the LukE/HlgA antibody or binding portion thereof comprises a light chain variable region comprising the CDR-L1 of SEQ ID NO: 574, the CDR-L2 of SEQ ID NO: 606, and the CDR-L3 of SEQ ID NO: 627. In another embodiment, the LukE/HgA antibody or binding portion thereof comprises a light chain variable region comprising the CDR-L1 of SEQ ID NO: 575, the CDR-L2 of SEQ ID NO: 607, and the CDR-L3 of SEQ ID NO: 628. In another embodiment, the LukE/HlgA antibody or binding portion thereof comprises a light chain variable region comprising the CDR-L1 of SEQ ID NO: 576, the CDR-L2 of SEQ ID NO: 608, and the CDR-L3 of SEQ ID NO: 629. In another embodiment, the LukE/HgA antibody or binding portion thereof comprises a light chain variable region comprising the CDR-L1 of SEQ ID NO: 577, the CDR-L2 of SEQ ID NO: 607, and the CDR-L3 of SEQ ID NO: 630. In another embodiment, the LukE/HlgA antibody or binding portion thereof comprises a light chain variable region comprising the CDR-L1 of SEQ ID NO: 578, the CDR-L2 of SEQ ID NO: 608, and the CDR-L3 of SEQ ID NO: 631. In another embodiment, the LukE/HgA antibody or binding portion thereof comprises a light chain variable region comprising the CDR-L1 of SEQ ID NO: 579, the CDR-L2 of SEQ ID NO: 602, and the CDR-L3 of SEQ ID NO: 632. In another embodiment, the LukE/HlgA antibody or binding portion thereof comprises a light chain variable region comprising the CDR-L1 of SEQ ID NO: 580, the CDR-L2 of SEQ ID NO: 607, and the CDR-L3 of SEQ ID NO: 633. In another embodiment, the LukE/HgA antibody or binding portion thereof comprises a light chain variable region comprising the CDR-L1 of SEQ ID NO: 581, the CDR-L2 of SEQ ID NO: 609, and the CDR-L3 of SEQ ID NO: 634. In another embodiment, the LukE/HlgA antibody or binding portion thereof comprises a light chain variable region comprising the CDR-L1 of SEQ ID NO: 582, the CDR-L2 of SEQ ID NO: 610, and the CDR-L3 of SEQ ID NO: 635. In another embodiment, the LukE/HgA antibody or binding portion thereof comprises a light chain variable region comprising the CDR-L1 of SEQ ID NO: 579, the CDR-L2 of SEQ ID NO: 602, and the CDR-L3 of SEQ ID NO: 636. In another embodiment, the LukE/HlgA antibody or binding portion thereof comprises a light chain variable region comprising the CDR-L1 of SEQ ID NO: 583, the CDR-L2 of SEQ ID NO: 608, and the CDR-L3 of SEQ ID NO: 631. In another embodiment, the LukE/HgA antibody or binding portion thereof comprises a light chain variable region comprising the CDR-L1 of SEQ ID NO: 584, the CDR-L2 of SEQ ID NO: 608, and the CDR-L3 of SEQ ID NO: 631. In another embodiment, the LukE/HlgA antibody or binding portion thereof comprises a light chain variable region comprising the CDR-L1 of SEQ ID NO: 585, the CDR-L2 of SEQ ID NO: 611, and the CDR-L3 of SEQ ID NO: 637. In another embodiment, the LukE/HgA antibody or binding portion thereof comprises a light chain variable region comprising the CDR-L1 of SEQ ID NO: 579, the CDR-L2 of SEQ ID NO: 602, and the CDR-L3 of SEQ ID NO: 638. In another embodiment, the LukE/HlgA antibody or binding portion thereof comprises a light chain variable region comprising the CDR-L1 of SEQ ID NO: 586, the CDR-L2 of SEQ ID NO: 612, and the CDR-L3 of SEQ ID NO: 639. In another embodiment, the LukE/HgA antibody or binding portion thereof comprises a light chain variable region comprising the CDR-L1 of SEQ ID NO: 587, the CDR-L2 of SEQ ID NO: 613, and the CDR-L3 of SEQ ID NO: 640. In another embodiment, the LukE/HlgA antibody or binding portion thereof comprises a light chain variable region comprising the CDR-L1 of SEQ ID NO: 588, the CDR-L2 of SEQ ID NO: 614, and the CDR-L3 of SEQ ID NO: 641. In another embodiment, the LukE/HgA antibody or binding portion thereof comprises a light chain variable region comprising the CDR-L1 of SEQ ID NO: 589, the CDR-L2 of SEQ ID NO: 615, and the CDR-L3 of SEQ ID NO: 642. In another embodiment, the LukE/HlgA antibody or binding portion thereof comprises a light chain variable region comprising the CDR-L1 of SEQ ID NO: 590, the CDR-L2 of SEQ ID NO: 601, and the CDR-L3 of SEQ ID NO: 64. In another embodiment, the LukE/HgA antibody or binding portion thereof comprises a light chain variable region comprising the CDR-L1 of SEQ ID NO: 581, the CDR-L2 of SEQ ID NO: 609, and the CDR-L3 of SEQ ID NO: 634. In another embodiment, the LukE/HlgA antibody or binding portion thereof comprises a light chain variable region comprising the CDR-L1 of SEQ ID NO: 591, the CDR-L2 of SEQ ID NO: 616, and the CDR-L3 of SEQ ID NO: 644. In another embodiment, the LukE/HgA antibody or binding portion thereof comprises a light chain variable region comprising the CDR-L1 of SEQ ID NO: 592, the CDR-L2 of SEQ ID NO: 601, and the CDR-L3 of SEQ ID NO: 645. In another embodiment, the LukE/HlgA antibody or binding portion thereof comprises a light chain variable region comprising the CDR-L1 of SEQ ID NO: 593, the CDR-L2 of SEQ ID NO: 617, and the CDR-L3 of SEQ ID NO: 646. In another embodiment, the LukE/HgA antibody or binding portion thereof comprises a light chain variable region comprising the CDR-L1 of SEQ ID NO: 594, the CDR-L2 of SEQ ID NO: 618, and the CDR-L3 of SEQ ID NO: 647. In another embodiment, the LukE/HlgA antibody or binding portion thereof comprises a light chain variable region comprising the CDR-L1 of SEQ ID NO: 595, the CDR-L2 of SEQ ID NO: 619, and the CDR-L3 of SEQ ID NO: 648. In another embodiment, the LukE/HgA antibody or binding portion thereof comprises a light chain variable region comprising the CDR-L1 of SEQ ID NO: 596, the CDR-L2 of SEQ ID NO: 620, and the CDR-L3 of SEQ ID NO: 649. In another embodiment, the LukE/HlgA antibody or binding portion thereof comprises a light chain variable region comprising the CDR-L1 of SEQ ID NO: 574, the CDR-L2 of SEQ ID NO: 621, and the CDR-L3 of SEQ ID NO: 650. In another embodiment, the LukE/HgA antibody or binding portion thereof comprises a light chain variable region comprising the CDR-L1 of SEQ ID NO: 597, the CDR-L2 of SEQ ID NO: 608, and the CDR-L3 of SEQ ID NO: 625. In another embodiment, the LukE/HlgA antibody or binding portion thereof comprises a light chain variable region comprising the CDR-L1 of SEQ ID NO: 573, the CDR-L2 of SEQ ID NO: 605, and the CDR-L3 of SEQ ID NO: 651. In another embodiment, the LukE/HgA antibody or binding portion thereof comprises a light chain variable region comprising the CDR-L1 of SEQ ID NO: 598, the CDR-L2 of SEQ ID NO: 607, and the CDR-L3 of SEQ ID NO: 652. In another embodiment, the LukE/HlgA antibody or binding portion thereof comprises a light chain variable region comprising the CDR-L1 of SEQ ID NO: 599, the CDR-L2 of SEQ ID NO: 607, and the CDR-L3 of SEQ ID NO: 653. In another embodiment, the LukE/HgA antibody or binding portion thereof comprises a light chain variable region comprising the CDR-L1 of SEQ ID NO: 574, the CDR-L2 of SEQ ID NO: 606, and the CDR-L3 of SEQ ID NO: 627. In another embodiment, the LukE/HlgA antibody or binding portion thereof comprises a light chain variable region comprising the CDR-L1 of SEQ ID NO: 600, the CDR-L2 of SEQ ID NO: 602, and the CDR-L3 of SEQ ID NO: 654.

In another embodiment, the LukE/HlgA antibody comprises the heavy chain CDRs of SEQ ID NOs: 513, 530, and 549 together with the light chain CDRs of SEQ ID NOs: 569, 601 and, 622; the heavy chain CDRs of SEQ ID NOs: 514, 531, and 550 together with the light chain CDRs of SEQ ID NOs: 570, 602, and 623; the heavy chain CDRs of SEQ ID NOs: 515, 532, and 551 together with the light chain CDRs of SEQ ID NOs: 571, 603, and 624; the heavy chain CDRs of SEQ ID NOs: 516, 533, and 552 together with the light chain CDRs of SEQ ID NOs: 572, 604, and 625; the heavy chain CDRs of SEQ ID NOs: 517, 534, and 553 together with the light chain CDRs of SEQ ID NOs: 573, 605, and 626; the heavy chain CDRs of SEQ ID NOs: 514, 535, and 554 together with the light chain CDRs of SEQ ID NOs: 574, 606, and 627; the heavy chain CDRs of SEQ ID NOs: 518, 536, and 555 together with the light chain CDRs of SEQ ID NOs: 575, 607, and 628; the heavy chain CDRs of SEQ ID NOs: 519, 537, and 556 together with the light chain CDRs of SEQ ID NOs: 576, 608, and 629; the heavy chain CDRs of SEQ ID NOs: 520, 538, and 557 together with the light chain CDRs of SEQ ID NOs: 577, 607, and 630; the heavy chain CDRs of SEQ ID NOs: 521, 539, and 558 together with the light chain CDRs of SEQ ID NOs: 578, 608, and 631; the heavy chain CDRs of SEQ ID NOs: 521, 539, and 558 together with the light chain CDRs of SEQ ID NOs: 579, 602, and 632; the heavy chain CDRs of SEQ ID NOs: 521, 539, and 558 together with the light chain CDRs of SEQ ID NOs: 580, 607, and 633; the heavy chain CDRs of SEQ ID NOs: 521, 539, and 558 together with the light chain CDRs of SEQ ID NOs:581, 609, and 634; the heavy chain CDRs of SEQ ID NOs: 521, 539, and 558 together with the light chain CDRs of SEQ ID NOs: 582, 610, and 635; the heavy chain CDRs of SEQ ID NOs: 521, 539, and 558 together with the light chain CDRs of SEQ ID NOs: 579, 602, and 636; the heavy chain CDRs of SEQ ID NOs: 522, 540, and 558 together with the light chain CDRs of SEQ ID NOs: 583, 608, and 631; the heavy chain CDRs of SEQ ID NOs: 523, 541, and 559 together with the light chain CDRs of SEQ ID NOs: 584, 608, and 631; the heavy chain CDRs of SEQ ID NOs: 523, 541, and 559 together with the light chain CDRs of SEQ ID NOs: 585, 611, and 637; the heavy chain CDRs of SEQ ID NOs: 523, 541, and 559 together with the light chain CDRs of SEQ ID NOs: 579, 602, and 638; the heavy chain CDRs of SEQ ID NOs: 523, 541, and 559 together with the light chain CDRs of SEQ ID NOs: 586, 612, and 639; the heavy chain CDRs of SEQ ID NOs: 523, 541, and 559 together with the light chain CDRs of SEQ ID NOs: 587, 613, and 640; the heavy chain CDRs of SEQ ID NOs: 523, 541, and 559 together with the light chain CDRs of SEQ ID NOs: 588, 614, and 641; the heavy chain CDRs of SEQ ID NOs: 524, 542, and 560 together with the light chain CDRs of SEQ ID NOs: 589, 615, and 642; the heavy chain CDRs of SEQ ID NOs: 525, 543, and 561 together with the light chain CDRs of SEQ ID NOs: 590, 601, and 643; the heavy chain CDRs of SEQ ID NOs: 526, 544, and 562 together with the light chain CDRs of SEQ ID NOs: 581, 609, and 634; the heavy chain CDRs of SEQ ID NOs: 526, 544, and 562 together with the light chain CDRs of SEQ ID NOs: 591, 616, and 644; the heavy chain CDRs of SEQ ID NOs: 526, 544, and 562 together with the light chain CDRs of SEQ ID NOs: 592, 601, and 645; the heavy chain CDRs of SEQ ID NOs: 526, 544, and 562 together with the light chain CDRs of SEQ ID NOs: 593, 617, and 646; the heavy chain CDRs of SEQ ID NOs: 526, 544, and 562 together with the light chain CDRs of SEQ ID NOs: 594, 618, and 647; the heavy chain CDRs of SEQ ID NOs: 526, 544, and 562 together with the light chain CDRs of SEQ ID NOs: 595, 619, and 648; the heavy chain CDRs of SEQ ID NOs: 527, 545, and 563 together with the light chain CDRs of SEQ ID NOs: 596, 620, and 649; the heavy chain CDRs of SEQ ID NOs: 528, 546, and 564 together with the light chain CDRs of SEQ ID NOs: 574, 621, and 650; the heavy chain CDRs of SEQ ID NOs: 525, 533, and 565 together with the light chain CDRs of SEQ ID NOs: 597, 608, and 625; the heavy chain CDRs of SEQ ID NOs: 520, 547, and 566 together with the light chain CDRs of SEQ ID NOs: 573, 605, and 651; the heavy chain CDRs of SEQ ID NOs: 529, 548, and 567 together with the light chain CDRs of SEQ ID NOs: 598, 607, and 652; the heavy chain CDRs of SEQ ID NOs: 529, 548, and 567 together with the light chain CDRs of SEQ D NOs:599, 607, and 653; the heavy chain CDRs of SEQ ID NOs:529, 548, and 567 together with the light chain CDRs of SEQ ID NOs: 574, 606, and 627; the heavy chain CDRs of SEQ ID NOs: 528, 546, and 568 together with the light chain CDRs of SEQ ID NOs: 574, 606, and 627; the heavy chain CDRs of SEQ ID NOs: 528, 546, and 568 together with the light chain CDRs of SEQ ID NOs:600, 602, and N654.

The LukE/HigA antibody or binding portion thereof as described herein may comprises a variable light (VL) chain, a variable heavy (VH) chain, or a combination of a VL and VH chain. The VL chain of the LukE/HgA antibody or binding portion thereof as disclosed herein may comprise an amino acid sequence selected from SEQ ID NOs: 655-693 or an amino acid sequence that is at least 80% identical to any one of the amino acid sequence selected from SEQ NOs:655-693. The VH chain of the LukE/HgA antibody of binding portion thereof may comprise an amino acid sequence selected from SEQ ID NOs: 694-732 or an amino acid sequence that is at least 80% identical to anyone of the amino acid sequence selected from SEQ TD NOs: 694-732. The amino acid sequences of the LukE/HlgA VL and VH chains are provided in Table 18A below.

TABLE 18A

LukE/HlgA Antibody Variable Light (VL) and Variable Heavy (VH) Chain Sequences

| mAb/Fab name | Region | Name | Sequence | SEQ ID NO: |
|---|---|---|---|---|
| SM1B302 | VL | C45L104 | DIQMTQSPSSLSASLGERVSLTCRASQDIGSSLNWLQQEPD GTIKRLIYATSSLDSGVPKRFSGSRSGSDYSLTISSLESED FVDYYCLQYASSPWTFGGGTKLEIK | 655 |

TABLE 18A-continued

LukE/HlgA Antibody Variable Light (VL) and
Variable Heavy (VH) Chain Sequences

| mAb/Fab name | Region | Name | Sequence | SEQ ID NO: |
|---|---|---|---|---|
| SM1B303 | VL | HLGL3 | DIQMTQTTSSLSASLGDRVTISCWASQDIRSYLNWYQQKPDGTVKLLIYYTSRLHSGVPSRFSGSGSGTDFSLTISNLEQEDIATYFCQQGNTLPYTFGGGTKLEIK | 656 |
| SM1B304 | VL | HLGL4 | DIQMTQSPSSLSASLGERVSLTCRASQEISGYLSWLQQKPDGTIKRLIYAASTLDSGVPKRFSGSRSGSDYSLTISSLESEDFADYYCLQYASYPRTFGGGTKLEIK | 657 |
| SM1B305 | VL | HLGL5 | DVLMTQTPLSLPVSLGDQASISCRSSQIIVHSNGNTYLDWYLQKPGQSPKLLIYKISNRFSGVPDRFSGSGSGTDFTLKISRVEAEDLGVYYCFQGSHVPWTFGGGTKLEIK | 658 |
| SM1B306 | VL | HLGL6 | DVVVTQTPLSLPVSFGDQVSISCRSSQSLANSYGNTYLSWYLHKPGQSPQLLIYGISNRFSGVPDRFSGSGSGTDFTLKISTIKPEGLGMYYCLQGTHQPPTFGAGTKLELK | 659 |
| SM1B307 | VL | HLGL7 | DIVLTQSPASLAVSLGQRATISCRASESVDSYGNSFMHWYQQKPGQPPKLLIYRASNLESGIPARFSGSGSRTDFTLTINPVEADDVATYYCQQSNEDPPWTFGGGTKLEIK | 660 |
| SM1B308 | VL | HLGL8 | DIVMSQSPSSLAVSAGEKVTMSCKSSQSLLNSRTRKNYLAWYQQKPGQSPKLLIYWASTRESGVPDRFTGSGSGTDFTLTISSVQAEDLAVYYCKQSYNLWTFGGGTKLEIK | 661 |
| SM1B309 | VL | HLGL9 | DVVMTQTPLSLPVSLGDQASISCRSSQSLLHSNGKTYLHWYLQKPGQSPKLLIYKVSNRFSGVPDRFSGSGSGTDFTLKISRVEAEDLGVYFCSQSTHVPLTFGAGTKLELK | 662 |
| SM1B310 | VL | HLGL10 | DIVMTQSHKFMSTSVGDRVSITCKASQDVSAAVAWYQQKPGQSPKLLIYWASTRHTGVPDRFTGSGSGTDYTLTISSVQAEDLALYYCQQHYSTPGTFGGGTKLEIK | 663 |
| SM1B311 | VL | HLGL11 | DVLMTQTPLSLPVSLGDQASISCRSSQTIVHSSGNTYLEWYLQRPGQSPKLLIYKVSNRFSGVPDRFSGSGSGTDFTLKISRVEAEDLGVYYCFQGSHVPYTFGGGTKLEIK | 664 |
| SM1B312 | VL | GC5L29 | DIQMTQTTSSLSASLGDRVTISCSASQGISNYLNWYQQKPDGTVKLLIYYTSSLHSGVPSRFSGSGSGTDYSLTISNLEPEDIATYYCQQYSKLPFTFGSGTKLEIK | 665 |
| SM1B313 | VL | HLGL12 | DIVMSQSPSSLAVSVGEKVTMSCKSSQSLLYSSNQKNYLAWYQQKPGQSPKLLIYWASTRESGVPDRLTGSGSGTDFTLTISSVKAEDLAVYYCQQYYSYPYTFGGGTKLEIK | 666 |
| SM1B314 | VL | OSML437 | DIQMTQSPASLSVSVGETVTITCRASENIYSNLAWYQQKQGKSPQLLVYAATNLADGVPSRFSGSGSGTQYSLKINSLQSEDFGSYYCQHFWGTPYTFGGGTKLEIK | 667 |
| SM1B315 | VL | TM3L53 | DIKMTQSPSSMYASLGERVTITCKASQDINSYLSWFQQKPGKSPKTLIYRANRLVDGVPSRFSGSGSGQDYSLTISSLEYEDMGIYYCLQYDEFPYTFGGGTKLEIK | 668 |
| SM1B316 | VL | HLGL13 | DIQMTQTTSSLSASLGDRVTISCSASQGISNYLNWYQQKPDGTVKLLIHYTSSLHSGVPSRFSGSGSGTDYSLTISNLEPEDIATYYCQQYSKLPWTFGGGTKLEIK | 669 |
| SM1B317 | VL | HLGL14 | DVLMTQTPLSLPVSLGDQASISCRSSQTIVYSDGNTYLEWYLQKPGQSPKLLIYKVSNRFSGVPDRVSGSGSGTDFTLKISRVEAEDLGVYYCFQGSHVPYTFGGGTKLEIK | 670 |
| SM1B318 | VL | HLGL14 | DVLMTQTPLSLPVSLGDQASISCRSSQTIVYSDGNTYLEWYLQKPGQSPKLLIYKVSNRFSGVPDRVSGSGSGTDFTLKISRVEAEDLGVYYCFQGSHVPYTFGGGTKLEIK | 671 |
| SM1B319 | VL | HLGL15 | DIVMTQAAPSVPVTPGESVSISCRSSKSLLHSNGNTYLYWFLQRPGQSPQLLIYRMSNLASGVPDRFSGSGSGTAFTLRISRVEADVGVYYCMQHLEYPFTFGSGTKLEIK | 672 |
| SM1B320 | VL | ATCL1 | DIQMTQTTSSLSASLGDRVTISCSASQGISNYLNWYQQKPDGTVKLLIYYTSSLHSGVPSRFSGSGSGTDYSLTISNLEPEDIATYYCQQYSKLPYTFGGGTKLEIK | 673 |
| SM1B321 | VL | VSTL360 | DIQMTQSPASLSASVGETVTIICRASENIYSYLAWYQQKQGKSPQLLVYNAKTLVEGVPSRFSGSGSGTQFSLKINSLQPEDFGSYYCQE1HYGSPYTFGGGTKLEIK | 674 |

TABLE 18A-continued

LukE/HlgA Antibody Variable Light (VL) and
Variable Heavy (VH) Chain Sequences

| mAb/Fab name | Region | Name | Sequence | SEQ ID NO: |
|---|---|---|---|---|
| SM1B322 | VL | ATCL3 | DIVMTQSHKFMSTSVGDRVSITCKASQDVSTAVAWYQQKPG<br>QSPKLLIYSASYRYTGVPDRFTGSGSGTDFTFTISSVQAED<br>LAVYYCQQHYSTPWTFGGGTKLEIK | 675 |
| SM1B323 | VL | HLGL16 | ETTVTQSPASLSMAIGEKVTIRCITSTDIDDDMNWYQQKPG<br>EPPKLLISEGNTLRPGVPSRFSSSGYGTDFVFTIENMLSED<br>VADYYCLQSDNLPYTFGGGTKLEIK | 676 |
| SM1B324 | VL | HLGL17 | DIVMTQSPSSLSVSAGEKVTMSCKSSQSLLNSGNQKNYLAW<br>YQQKPGQPPKLLIYGASTRESGVPDRFTGSGSGTDFTLTIS<br>SVQAEDLAVYYCQNDHSYPPTFGGGTKLEIK | 677 |
| SM1B325 | VL | HLGL18 | DIQMTQSPSSLSASLGERVSLTCRASQDIGNSLNWLQQKPD<br>GTIKRLIYATSNLDSGVPKRFSGSRSGSDYSLTISSLESED<br>FVNYYCLQFASSPLTFGTGTKLEIK | 678 |
| SM1B326 | VL | OSML437 | DIQMTQSPASLSVSVGETVTITCRASENIYSNLAWYQQKQG<br>KSPQLLVYAATNLADGVPSRFSGSGSGTQYSLKINSLQSED<br>FGSYYCQHFWGTPYTFGGGTKLEIK | 679 |
| SM1B327 | VL | HLGL19 | QIVLTQSPAIMSASPGEKVTMTCSASSNVSYMEIWFQQKSG<br>TSPKRWIYDTSKLASGVPARFSGSGSGTSYSLTVSSMEAED<br>AATYYCQQWSSNPRTFGGGTKLEIK | 680 |
| SM1B328 | VL | VSTL342 | DIQMTQSPSSLSASLGERVSLTCRASQDIGSYLNWLQQEPD<br>GTIKRLIYATSSLDSGVPKRFSGSRSGADYSLTISSLESED<br>FVDYYCLQYATSPWTFGGGTKLEIK | 681 |
| SM1B329 | VL | HLGL20 | DIQMTQSSSYLSVSLGGRVTITCKASDHINNWLAWYQQKPG<br>NAPRLLISGATSLETGVPSRFSGSGSGKDYTLSITSLQTED<br>VATYYCQQYWSTPYTFGGGTKLEIK | 682 |
| SM1B330 | VL | HLGL21 | QIVLTQSPALMSASPGEKVTMTCSASSSVSYMYWYQQKPRS<br>SPKLKYASNLASGVPARFSGSGSGTSYSLTISSMEAEDAAT<br>YYCQQWSSNPPITFGAGTKLELK | 683 |
| SM1B331 | VL | VSTL368 | DIVMTQSPATLSVTPGDRVSLSCRASQSISDYLHWYQQKSH<br>ESPRLLIKYDSQSISGIPSRFSGSGSGSDFTLSINSVEPED<br>VGVYYCQNGHRFPFTFGGGTKLEIK | 684 |
| SM1B332 | VL | HLGL22 | QIVLTQSPAIMSASPGEKVTLTCSASSSVSSSYLFWYQQKP<br>GSSPKLWIYSTSNLASGVPVRFSGSGFGTSYSLTISRMEAE<br>DAASYFCHQWSSYPPTFGAGTKLELK | 685 |
| SM1B333 | VL | HLGL23 | DIVLTQSPASLAVSLGQRATISCRASESVDSYGNSFMHWYQ<br>QKPGQPPKLLIYLASNLESGVPARFSGSGSRTDFTLTIDPV<br>EADDAATYYCQQNNEDPYTFGGGTKLEIK | 686 |
| SM1B334 | VL | HLGL24 | DVLMTQTPLSLPVSLGDQASISCRSSQSIVYSNGNTYLDWY<br>LQKPGQPPKLLIYKVSNRFSGVPDRFSGSGSGTDFILKISR<br>VEAEDLGVYYCFQGSHVPWTFGGGTKLEIK | 687 |
| SM1B335 | VL | HLGL25 | DVVVTQTPLSLPVSFGDQVSISCRSSQSLANSYGNTYLSWY<br>LHKPGQSPQLLIYGISNRFSGVPDRFSGSGSGTDFTLKIST<br>IKPEDLGMYYCLQGTHQPYTFGGGTKLEIK | 688 |
| SM1B336 | VL | HLGL26 | DIVMSQSPSSLAVSVGEKVTMSCKSSQSVLYNSNQRNYLAW<br>YQQKPGQSPKLLIYWASTRESGVPDRSTGSGSGTDFTLTIS<br>SVQAEDLAVYYCHQYLSSYTFGGGTKLEIK | 689 |
| SM1B337 | VL | HLGL27 | DIVMTQSHKFMSTSVGDRVSITCKASQDVGTAVAWYQQKPG<br>QSPKLLIYWASTRHTGVPDRFTGSGSGTDFTLTISNVQSED<br>LADYFCQQYSSYPLTFGAGTKLELK | 690 |
| SM1B338 | VL | HLGL7 | DIVLTQSPASLAVSLGQRATISCRASESVDSYGNSFMHWYQ<br>QKPGQPPKLLIYRASNLESGIPARFSGSGSRTDFTLTINPV<br>EADDVATYYCQQSNEDPPWTFGGGTKLEIK | 691 |
| SM1B339 | VL | HLGL7 | DIVLTQSPASLAVSLGQRATISCRASESVDSYGNSFMHWYQ<br>QKPGQPPKLLIYRASNLESGIPARFSGSGSRTDFTLTINPV<br>EADDVATYYCQQSNEDPPWTFGGGTKLEIK | 692 |

TABLE 18A-continued

LukE/HlgA Antibody Variable Light (VL) and
Variable Heavy (VH) Chain Sequences

| mAb/Fab name | Region | Name | Sequence | SEQ ID NO: |
|---|---|---|---|---|
| SM1B340 | VL | HLGL28 | DIQMTQTTSSLSASLGDRVTISCRASQDIDNYLNWYQQKPD GTVKLLISYTSRLHSGVPSRFSGSGSGTDYSLTISNLEQED FATYFCQQGYTLPWTFGGGTKLEIK | 693 |
| SM1B302 | VH | HLGH3 | EVKLVESGGDLVKPGGSLKLSCAASGFTFSSFAMSWVRQTP EKRLEWVASISRTDNTYYPDSMKGQFTISRDNARNILYLQM SSLRSENTAIYYCARADYDGPWFAYWGQGTLVTVSA | 694 |
| SM1B303 | VH | HLGH4 | EVQLQQSGPDLVKPGTSVKMSCKASGYSFTGYYMETWVKQS HGKSLEWIGRVNPNNGGTSYNQKFKGKAILTVDKSSSTAYM ELRSLTSEDSAVYYCARDDYSFAYWGQGTLVTVSA | 695 |
| SM1B304 | VH | HLGH5 | EVKLVESGGGLVQPGGSLRLSCATSGFTFTDFYMSWVRQPP GKALEWLAFIRNKANGYTTEYSSSVRGRFTISRDNSQSILY LQMNTLRAEDSGTYYCARDVGDYDYWGQGSTLTVSS | 696 |
| SM1B305 | VH | HLGH6 | QIQLVQSGPELKKPGETVKISCKASGFTFTNYGMNWVKQAP GKDLKWMGWINTYTGEPTYADDFKGRFAFSLETSASTAYLQ INNLKDEDTASYFCARDYRDGDALDYWGQGTSVTVSS | 697 |
| SM1B306 | VH | HLGH7 | QVQLQQPGAELVRPGASVKLSCKASGYSFTSNWMNWMKQRP GQGLEWIGMTHPSDSESRLNQKFKDKATLTVDKSSSTAYMQ LSSPTSEDSAVYYCARGDGGFAYWGQGTLVTVSA | 698 |
| SM1B307 | VH | HLGH8 | EVKLQQSGPELVKPGASMKISCKASGYSFTGYTMNWAKQSH GKNLEWIGLINPYNGGTSYNQKFKGKATLTVDKSSSTAYME LLSLTSEDSAVYYCARGYPRGWFAYWGQGTLVTVSA | 699 |
| SM1B308 | VH | HLGH9 | DVKLVESGGGLVKPGGSLKLSCAASGFTFRNHAMSWVRQTP EKRLEWVAAINVNAGSTYYPDTVKDRFTISRDNAKNTLYLQ MSSLRSEDTALYYCARHRAYYNYDENAMDYWGQGTSVTVSS | 700 |
| SM1B309 | VH | HLGH10 | EVQLQQSGPELVKPGDSVKMSCKASGYTFTDYYIDWMKQSH GKSLEWIGYIYPNNGGTSYNQFKDKATLTVDKSSSTAYME LHSLTSEDSAVYYCARLTYYAKVDSWGQGTSVTVSS | 701 |
| SM1B311 | VH | HLGH11 | DVKLVESGGGLVEWEGVLKLSCAASGFTFSSYAMSWVRQTP EKRLEWVAAINSNGGSTYYPDTVKDRFTISRDNAKNTLYLQ MSSLRSEDTALYYCARLYYGDYWGQGTTLTVSS | 702 |
| SM1B312 | VH | HLGH12 | QVQLKQSGPSLVQPSQSLSITCTVSGFSLTTYGLHWIRQSP GKGLEWLGVIWRGGTTDYNAAFMSRLTITKDNSKSQVFFKM NSLQADDTAIYYCARTDIWGAGTTVTVSS | 703 |
| SM1B312 | VH | HLGH12 | QVQLKQSGPSLVQPSQSLSITCTVSGFSLTTYGLHWIRQSP GKGLEWLGVIWRGGTTDYNAAFMSRLTITKDNSKSQVFFKM NSLQADDTAIYYCARTDIWGAGTTVTVSS | 704 |
| SM1B313 | VH | HLGH12 | QVQLKQSGPSLVQPSQSLSITCTVSGFSLTTYGLHWIRQSP GKGLEWLGVIWRGGTTDYNAAFMSRLTITKDNSKSQVFFKM NSLQADDTAIYYCARTDIWGAGTTVTVSS | 705 |
| SM1B313 | VH | HLGH13 | QVQLKQSGPGLVQPSQSLPITCTVSGFSLTTYGLHWIRQSP GKGLEWLGVIWRGGTTDYNAAFMSRLTITKDNSKSQVFFKM NSLQADDTAIYYCARTDIWGAGTTVTVSS | 706 |
| SM1B315 | VH | HLGH14 | QVQLKQSGPGLVQPSQSLSITCTVSGFSLTTYGLHWIRQSP GKGLEWLGVIWRGGTTDYNAAFMSRLTITKDNSKSQVFFKM NSLQADDTAIYYCARTDIWGAGTTVTVSS | 707 |
| SM1B316 | VH | HLGH12 | QVQLKQSGPSLVQPSQSLSITCTVSGFSLTTYGLHWIRQSP GKGLEWLGVIWRGGTTDYNAAFMSRLTITKDNSKSQVFFKM NSLQADDTAIYYCARTDIWGAGTTVTVSS | 708 |
| SM1B317 | VH | HLGH15 | QVQLKQSGPGLVQPSQSLSITCTVSGFSLTSYGVHWVRQPP GKGLEWLGVIWSGGITDYNAAFISRLSISKDNSKSQVFFKM NSLQADDTAIYYCARTDLWGQGTLVTVSA | 709 |
| SM1B318 | VH | HLGH16 | QVQLQQSGAELMNPGASVKISCKSTGYKFSSYWIEWVKQRP GHGLEWMGEILPGSGSTNHNEKFKGKAIFTADASSNTAYME LSSLTSEDSAVYYCARTISTATDWFAYWGQGTLVTVSA | 710 |
| SM1B319 | VH | HLGH16 | QVQLQQSGAELMNPGASVKISCKSTGYKFSSYWIEWVKQRP GHGLEWMGEILPGSGSTNHNEKFKGKAIFTADASSNTAYME LSSLTSEDSAVYYCARTISTATDWFAYWGQGTLVTVSA | 711 |

TABLE 18A-continued

LukE/HlgA Antibody Variable Light (VL) and
Variable Heavy (VH) Chain Sequences

| mAb/Fab name | Region | Name | Sequence | SEQ ID NO: |
| --- | --- | --- | --- | --- |
| SM1B320 | VH | HLGH17 | QVQLQQSGAELMKPGASVKMSCKATGYKFSSYWIEWVKQRP<br>GHGLEWMGEILPGSGSTNHNEKFKGKAIFTADASSNTAYME<br>LSSLTSEDSAVYYCARTISTATDWFAYWGQGTLVTVSA | 712 |
| SM1B321 | VH | HLGH18 | QVQLQQSGAELMKPGASVKMSCKATGYKFSSYWIEWVKQRP<br>GHGLEWMGEILPGSGSTNHNEKFTGRAIFTADASSNTAYME<br>LSSLTSEDSAVYYCARTISTATDWFAYWGQGTLVTVSA | 713 |
| SM1B322 | VH | HLGH19 | QVQLQQSGAELMKPGASVKMSCKATGYKFSSYWIEWVKQRP<br>GHGLEWMGEILPGSGSTNHNEKFKGKAIFTADASSNTAYME<br>LSSLTSEDSAVYYCARTISTATDWFAYWGQGTLVTVSA | 714 |
| SM1B323 | VH | HLGH19 | QVQLQQSGAELMKPGASVKMPCKATGYKFSSYWIEWVKQRP<br>GHGLEWMGEILPGSGSTNHNEKFKGKAIFTADASSNTAYME<br>LSSLTSEDSAVYYCARTISTATDWFAYWGQGTLVTVSA | 715 |
| SM1B324 | VH | HLGH20 | EVQLQQSGAELVRPGALVKLSCKASGFNIKDYYMEIWVKQR<br>PEQGLEWIGWIDPENGNTIYDPKFQGKASITADTSSNTAYL<br>QLSSLTSEDTAVYYCARYDGYAMDYWGQGTSVTVSS | 716 |
| SM1B325 | VH | HLGH21 | QVQLQQSGAELVRPGTSVKMSCKAAGYTFTNYWIGWVKQRP<br>GHGLEWIGDIYPGGGYTNYNEKFKDKTTLTADTSSNTAYMQ<br>LSSLTSEDSAIYYCASNDCWGQGTTLTVSS | 717 |
| SM1B326 | VH | HLGH22 | QVQLKQSGPGLVQPSQSLSITCTVSGFSITSYGVHWIRQSP<br>GKGLEWLGVIWSGGSTDYNAAFISRLSISEDNSKSQVFFKM<br>NSLQANDTAIYYCATFYYDYDEGFDYWGQGTTLTVSS | 718 |
| SM1B327 | VH | HLGH23 | QVQLKQSGPGLVQPSQSLSITCTVSGFSITSYGVHWIRQSP<br>GKGLEWLGVIWSGGSTDYNAAFISRLSISKDNSKSQVFFKM<br>NSLQANDTAIYYCATFYYDYDEGFDYWGQGTTLTVSS | 719 |
| SM1B328 | VH | HLGH23 | QVQLKQSGPGLVQPSQSLSITCTVSGFSITSYGVHWIRQSP<br>GKGLEWLGVIWSGGSTDYNAAFISRLSISKDNSKSQVFFKM<br>NSLQANDTAIYYCATFYYDYDEGFDYWGQGTTLTVSS | 720 |
| SM1B329 | VH | HLGH23 | QVQLKQSGPGLVQPSQSLSITCTVSGFSITSYGVHWIRQSP<br>GKGLEWLGVIWSGGSTDYNAAFISRLSISKDNSKSQVFFKM<br>NSLQANDTAIYYCATFYYDYDEGFDYWGQGTTLTVSS | 721 |
| SM1B330 | VH | HLGH23 | QVQLKQSGPGLVQPSQSLSITCTVSGFSITSYGVHWIRQSP<br>GKGLEWLGVIWSGGSTDYNAAFISRLSISKDNSKSQVFFKM<br>NSLQANDTAIYYCATFYYDYDEGFDYWGQGTTLTVSS | 722 |
| SM1B331 | VH | HLGH23 | QVQLKQSGPGLVQPSQSLSITCTVSGFSITSYGVHWIRQSP<br>GKGLEWLGVIWSGGSTDYNAAFISRLSISKDNSKSQVFFKM<br>NSLQANDTAIYYCATFYYDYDEGFDYWGQGTTLTVSS | 723 |
| SM1B332 | VH | HLGH24 | QVQLKESGPGLVAPSQSLSITCTVSGLSTSYGLSWVRQPP<br>GKGLEWLGVIWGDGSTNYHSALISRLSISKDNSKSQVFLKL<br>NSLQSDDTATYYCATRGDYGSYAMDYWGQGTSVTVSS | 724 |
| SM1B333 | VH | HLGH25 | EVQLQQSGAELVRPGASVKLSCTASGFNIKDSLIHWVKQRP<br>EQGLEWIGWIDPEDGETKYAPKFQDKAALTTDTSSNTAYLE<br>ILNSLTSEDTAIYYCGRGGLILDYWGQGTTLTVSS | 725 |
| SM1B334 | VH | HLGH26 | QIQLVQSGPELKKPGETVKISCRSSGYTFTNYGLNWVKQAP<br>GKDLKWMGWLNTYTGEPTYADDFKGRFAFSLETSAGTAYLQ<br>INNLKNEDTATYFCSRDYREGDAMDYWSQGTSVTVSS | 726 |
| SM1B335 | VH | HLGH27 | EVQLVESGGGLVKPGGSLKLSCAASGFTFSSYAMSWVRQTP<br>EKRLEWVATISTSGSYTYYRDSVKGRLTISRDNAKNTLYLQ<br>MTSLRSEDTAMYYCTRHGDHDGFDYWGQGTTLTVSS | 727 |
| SM1B336 | VH | HLGH28 | EVQLVESGGGLVKPGGSLKLSCVASGFSFSNYAMSWVRQTP<br>ERRLEWVATINSGGSFSFFPDSVKGRFTISRDSAKNTLYLQ<br>MSSLRSDDTAMYYCTRHWDEIPWFAYWGQGTLVTVSA | 728 |
| SM1B337 | VH | HLGH28 | EVQLVESGGGLVKPGGSLKLSCVASGFSFSNYAMSWVRQTP<br>ERRLEWVATINSGGSFSFFPDSVKGRFTISRDSAKNTLYLQ<br>MSSLRSDDTAMYYCTRHWDEIPWFAYWGQGTLVTVSA | 729 |

TABLE 18A-continued

LukE/HlgA Antibody Variable Light (VL) and Variable Heavy (VH) Chain Sequences

| mAb/Fab name | Region | Name | Sequence | SEQ ID NO: |
|---|---|---|---|---|
| SM1B338 | VH | HLGH28 | EVQLVESGGGLVKPGGSLKLSCVASGFSFSNYAMSWVRQTP ERRLEWVATINSGGSFSFFPDSVKGRFTISRDSAKNTLYLQ MSSLRSDDTAMYYCTRHWDEIPWFAYWGQGTLVTVSA | 730 |
| SM1B338 | VH | HLGH28 | EVQLQQSGAELVRPGASVKLSCTTSGFNIKDSLIYWVKQRP EQGLEWIGWIDPEDGETKFAPRFQDKATITSDTSSNTAYLR LSSLTSKDTAIYYCTRSFGVCWGQGTLVTVSA | 731 |
| SM1B340 | VH | HLGH30 | EVQLQQSGAELVRPGASVKLSCTTSGFNIKDSLIYWVKQRP EQGLEWIGWIDPEDGETKFAPRFQDKATITSDTSSNTAYLR LSSLTSEDTAIYYCTRSFGVCWGQGTLVTVSA | 732 |

In another embodiment, the antibody or binding fragment thereof comprises a VH region having an amino acid sequence that shares at least 60%, at least 65%, at least 70%, at least 75%, at least 80%, at least 85%, at least 90%, at least 91%, at least 92%, at least 93%, at least 94% at least 95%, at least 96%, at least 97%, at least 98%, at least 99% sequence identity to any one of SEQ ID NOs: 694-732 as shown in Table 18A, and/or a VL region having an amino acid sequence that shares at least 60%, at least 65%, at least 70%, at least 75%, at least 80%, at least 85%, at least 90%, at least 91%, at least 92%, at least 93%, at least 94% at least 95%, at least 96%, at least 97%, at least 98%, at least 99% sequence identity to any one of SEQ ID NOs: 655-693 as shown in Table 18A.

In one embodiment, the antibody or binding fragment thereof of the present disclosure comprises a humanized VH variant of any one of SEQ ID NOs: 694-732 and/or a humanized VL variant of any one of SEQ ID NOs: 655-693, where the framework regions are humanized or replaced with human immunoglobulin framework sequences. The humanized framework regions are designed to be similar in length and sequence to the parental framework sequences within SEQ ID NOs: 655-732, respectively. In one embodiment, the humanized framework regions share 50%, 55%, 60%, 65%, 70%, 75%, 80%, 85%, 90%, 95% or more sequence identity to the framework regions of any one of SEQ ID NOs: 655-732, respectively. In another embodiment, the humanized framework regions are 60%, 65%, 70%, 75%, 80%, 85%, 90%, 95% or more similar in length to the framework regions of any one of SEQ ID NOs: 655-732, respectively. Humanized variants of the VH of any one of SEQ ID NOs: 694-732 and the VL of any one of SEQ ID NOs: 655-693 share at least 50%, at least 55%, at least 60%, at least 65%, at least 70%, at least 75%, at least 80%, at least 85%, at least 90%, at least 95% sequence identity along the entire length of SEQ ID NOs: 694-732 and SEQ ID NOs: 655-693, respectively.

Suitable LukE/HlgA antibodies as disclosed herein comprise a VL of SEQ ID NO: 655 and a VH of SEQ ID NO:694; a VL of SEQ ID NO: 656 and a VH of SEQ ID NO: 695; a VL of SEQ ID NO: 657 and a VH of SEQ ID NO:696; a VL of SEQ ID NO: 658 and a VH of SEQ ID NO:697; a VL of SEQ ID NO: 659 and a VH of SEQ ID NO: 698; a VL of SEQ ID NO: 660 and a VH of SEQ ID NO: 699; a VL of SEQ ID NO: 661 and a VH of SEQ ID NO: 700; a VL of SEQ ID NO: 662 and a VH of SEQ ID NO: 701; a VL of SEQ ID NO: 663 and a VH of SEQ ID NO: 702; a VL of SEQ ID NO: 664 and a VH of SEQ ID NO: 703; a VL of SEQ ID NO: 665 and a VH of SEQ ID NO: 704; a VL of SEQ ID NO: 666 and a VH of SEQ ID NO: 705; a VL of SEQ ID NO: 667 and a VH of SEQ ID NO: 706; a VL of SEQ ID NO: 668 and a VH of SEQ ID NO: 707; a VL of SEQ ID NO: 669 and a VH of SEQ ID NO: 708; a VL of SEQ ID NO: 670 and a VH of SEQ ID NO: 709; a VL of SEQ ID NO: 671 and a VH of SEQ ID NO: 710; a VL of SEQ ID NO: 672 and a VH of SEQ ID NO: 711; a VL of SEQ ID NO: 673 and a VH of SEQ ID NO: 712; a VL of SEQ ID NO: 674 and a VH of SEQ ID NO: 713; a VL of SEQ ID NO: 675 and a VH of SEQ ID NO: 714; a VL of SEQ ID NO: 676 and a VH of SEQ ID NO: 715; a VL of SEQ ID NO: 677 and a VH of SEQ ID NO: 716; a VL of SEQ ID NO: 678 and a VH of SEQ ID NO: 717; a VL of SEQ ID NO: 679 and a VH of SEQ ID NO: 718; a VL of SEQ ID NO: 680 and a VH of SEQ ID NO: 719; a VL of SEQ ID NO: 681 and a VH of SEQ ID NO: 720; a VL of SEQ ID NO: 682 and a VH of SEQ ID NO: 721; a VL of SEQ ID NO: 683 and a VH of SEQ ID NO: 722; a VL of SEQ ID NO: 684 and a VH of SEQ ID NO: 723; a VL of SEQ ID NO: 685 and a VH of SEQ ID NO: 724; a VL of SEQ ID NO: 686 and a VH of SEQ ID NO: 725; a VL of SEQ ID NO: 687 and a VH of SEQ ID NO: 726; a VL of SEQ ID NO: 688 and a VH of SEQ ID NO: 727; a VL of SEQ ID NO: 689 and a VH of SEQ ID NO: 728; a VL of SEQ ID NO: 690 and a VH of SEQ ID NO: 729; a VL of SEQ ID NO: 691 and a VH of SEQ ID NO: 730; a VL of SEQ ID NO: 692 and a VH of SEQ ID NO: 731; or a VL of SEQ ID NO: 693 and a VH of SEQ ID NO: 732.

In one embodiment, the LukE/HlgA antibody is a LukE/HlgA antigen-binding fragment, i.e., a Fab, comprising the heavy chain variable region (VH) and first heavy chain constant domain (CH1) of an antibody coupled to the light chain variable region (VL) and light chain constant region (CL) of the antibody. In another embodiment, the LukE/HgA antibody is a F(ab')$_2$ fragment, which comprises both LukE/HlgA antigen-binding fragments of the full-length antibody coupled by the hinge region. The heavy chain and light chain portions of exemplary LukE/HlgA Fab fragments are provided in Table 18B below. Exemplary LukE/HlgA Fab or F(ab')$_2$ fragments comprise as disclosed herein, a HC region of SEQ ID NO: 1308 and a LC region OF SEQ ID NO: 1312 (SM1B309); a HC region of SEQ ID NO: 1309 and a LC region of SEQ ID NO: 1313 (SM1B318); a HC region of SEQ ID NO: 1310 and a LC region of SEQ ID NO: 1314 (SM1B325); a HC region of SEQ ID NO: 1311 and a LC region of SEQ ID NO: 1315 (SM1B440).

TABLE 18B

LukE/HlgA Fab Amino Acid Heavy Chain (HC) and Light Chain (LC) Sequences

| Protein AA ID | Fab of | Region | Fab Amino Acid Sequence | SEQ ID NO: |
|---|---|---|---|---|
| SM1B437 | SM1B309 | HC | EVQLQQSGPELVKPGDSVKMSCKASGYTFTDYYIDWMKQSHGKSLEWIGYIYPNNGGTSYNQNFKDKATLTVDKSSSTAYMELHSLTSEDSAVYYCARLTYYAKVDSWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCHHHHHH | 1308 |
| SM1B438 | SM1B318 | HC | QVQLQQSGAELMNPGASVKISCKSTGYKFSSYWIEWVKQRPGHGLEWMGEILPGSGSTNHNEKFKGKAIFTADASSNTAYMELSSLTSEDSAVYYCARTISTATDWFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCHHHHHH | 1309 |
| SM1B439 | SM1B325 | HC | QVQLQQSGAELVRPGTSVKMSCKAAGYTFTNYWIGWVKQRPGHGLEWIGDIYPGGGYTNYNEKFKDKTTLTADTSSNTAYMQLSSLTSEDSAIYYCASNDCWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCHHHHHH | 1310 |
| SM1B440 | SM1B332 | HC | QVQLKESGPGLVAPSQSLSITCTVSGLSLTSYGLSWVRQPPGKGLEWLGVIWGDGSTNYHSALISRLSISKDNSKSQVFLKLNSLQSDDTATYYCATRGDYGSYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCHHHHHH | 1311 |
| SM1B437 | SM1B309 | LC | DVVMTQTPLSLPVSLGDQASISCRSSQSLLHSNGKTYLHWYLQKPGQSPKLLIYKVSNRFSGVPDRFSGSGSGTDFTLKISRVEAEDLGVYFCSQSTHVPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | 1312 |
| SM1B438 | SM1B318 | LC | DVLMTQTPLSLPVSLGDQASISCRSSQTIVYSDGNTYLEWYLQKPGQSPKLLIYKVSNRFSGVPDRVSGSGSGTDFTLKISRVEAEDLGVYYCFQGSHVPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | 1313 |
| SM1B439 | SM1B325 | LC | DIQMTQSPSSLSASLGERVSLTCRASQDIGNSLNWLQQKPDGTIKRLIYATSNLDSGVPKRFSGSRSGSDYSLTISSLESEDFVNYYCLQFASSPLTFGTGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | 1314 |
| SM1B440 | SM1B332 | LC | QIVLTQSPAIMSASPGEKVTLTCSASSSVSSSYLFWYQQKPGSSPKLWIYSTSNLASGVPVRFSGSGFGTSYSLTISRMEAEDAASYFCHQWSSYPPTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | 1315 |

In another embodiment, the LukE/HlgA Fab or F(ab')₂ fragments as disclosed above comprise a heavy chain region having an amino acid sequence that shares at least 60%, at least 65%, at least 70%, at least 75%, at least 80%, at least 85%, at least 90%, at least 91%, at least 92%, at least 93% at least 94% at least 95% at least 96%, at least 97% at least 98%, at least 99% sequence identity to any one of SEQ ID NOs: 1308-1311 as shown in Table 18I, and/or alight chain region having an amino acid sequence that shares at least 60%, at least 65%, at least 70%, at least 75% at least 80%, at least 85%, at least 90%, at least 91%, at least 92%, at least 93% at least 94% at least 95% at least 96%, at least 97%, at least 98%, at least 99% sequence identity to any one of SEQ ID NOs: 1312-1315 as shown in Table 18B. Additional LukE/HlgA Fab or F(ab')2 fragments of the present disclosure include those derived from the full-length LukE/HlgA light chain and heavy chain sequences disclosed in Table 24 below (i.e., full length LukE/HlgA light chain sequences of SEQ ID NO: 733-771 and heavy chain sequences of SEQ ID NOs: 772-810).

Exemplary LukE/HlgA antibodies of the present disclosure comprising the VL and VH chains as enumerated above are provided in Table 24 by their respective full-length LC and HC sequences. In particular, the amino acid sequences of the full-length light chain corresponding to and comprising the VL of SEQ ID NOs: 655-693 are provided as SEQ ID NO: 733-771 in Table 24, respectfully. The amino acid sequences of the full-length heavy chains corresponding to and comprising the VH of SEQ ID NOs: 694-732 are provided as SEQ ID NOs: 772-810 in Table 24, respectively.

Another aspect of the present disclosure relates to an antibody or binding portion thereof that competes for LukE and/or HlgA binding with a monoclonal antibody as disclosed herein. In particular, the present disclosure encompasses an antibody or binding portion thereof that competes for binding to LukE and/or HlgA with a monoclonal antibody comprising: (i) a heavy chain variable region comprising the CDR-H1 of SEQ ID NO: 519, the CDR-H2 of SEQ ID NO: 537, and the CDR-H3 of SEQ ID NO: 556, and a light chain variable region comprising the CDR-L1 of SEQ ID NO: 576, the CDR-L2 of SEQ ID NO: 608, and the CDR-L3 of SEQ ID NO: 629; (ii) a heavy chain variable region comprising the CDR-H1 of SEQ ID NO: 521, the CDR-H2 of SEQ ID NO: 539, and the CDR-H3 of SEQ ID NO: 558, and a light chain variable region comprising the CDR-L1 of SEQ ID NO: 578, the CDR-L2 of SEQ ID NO: 608, and the CDR-L3 of SEQ ID NO: 631; (iii) a heavy chain variable region comprising the CDR-H1 of SEQ ID NO: 522, the CDR-H2 of SEQ ID NO: 540, and the CDR-H3 of SEQ ID NO: 558, and a light chain variable region comprising the CDR-L1 of SEQ ID NO: 583, the CDR-L2 of SEQ ID NO: 608, and the CDR-L3 of SEQ ID NO: 631; (iv) a heavy chain variable region comprising the CDR-H1 of SEQ ID NO: 523, the CDR-H2 of SEQ ID NO: 541, and the CDR-H3 of SEQ ID NO: 559, and a light chain variable region comprising the CDR-L1 of SEQ ID NO: 584, the CDR-L2 of SEQ ID NO: 608, and the CDR-L3 of SEQ ID NO: 631; (v) a heavy chain variable region comprising the CDR-H1 of SEQ ID NO: 524, the CDR-H2 of SEQ ID NO: 542, and the CDR-H3 of SEQ ID NO: 560, and a light chain variable region comprising the CDR-L1 of SEQ ID NO: 589, the CDR-L2 of SEQ ID NO: 615, and the CDR-L3 of SEQ ID NO:642; (vi) a heavy chain variable region comprising the CDR-H1 of SEQ ID NO: 525, the CDR-H2 of SEQ ID NO: 543, and the CDR-H3 of SEQ ID NO: 561 and a light chain variable region comprising the CDR-L1 of SEQ ID NO: 590, the CDR-L2 of SEQ ID NO: 601, and the CDR-L3 of SEQ ID NO: 643; and (vii) a heavy chain variable region comprising the CDR-H1 of SEQ ID NO: 527, the CDR-H2 of SEQ ID NO: 545 and the CDR-H3 of SEQ ID NO: 563, and a light chain variable region comprising the CDR-L1 of SEQ ID NO: 596, the CDR-L2 of SEQ ID NO: 620, and the CDR-L3 of SEQ ID NO: 649.

Another aspect of the present disclosure is directed to nucleic acid molecules encoding the *S. aureus* antibodies or binding portions thereof as described herein. The nucleic acid molecules described herein include isolated polynucleotides, recombinant polynucleotide sequences, portions of expression vectors or portions of linear DNA sequences, including linear DNA sequences used for in vitro or in vivo transcription/translation, and vectors compatible with prokaryotic, eukaryotic or filamentous phage expression, secretion, and/or display of the antibodies or binding fragments thereof described herein.

In one embodiment, exemplary nucleic acid molecules include those encoding the $V_H$ and $V_L$ regions of the staphylococcal LukAB, LukD, LukD, HlgA, HlgC, and LukE/HlgA antibodies as described supra or humanized versions of the VH and VL chains described supra. In another embodiment, exemplary recombinant nucleic acid molecules include those encoding the heavy chain and light chain components of the staphylococcal LukAB, LukD, LukD, HlgA, HlgC, and LukE/HlgA Fabs described herein. In another embodiment, exemplary recombinant nucleic acid molecules include those encoding the heavy chain and light chain components of the staphylococcal LukAB, LukD, LukD, HlgA, HlgC, and LukE/HlgA antibodies described herein.

Suitable nucleic acid sequences (i.e., primary transcripts and coding DNA sequences (CDS)) encoding the LukAB antibody heavy chain polypeptides and light chain polypeptides described herein are enumerated in Tables 26-29 and include SEQ ID NOs: 834-997. Nucleic acid molecules having nucleotide sequences that differ from SEQ ID NOs: 834-997, which as a result of the degeneracy of the genetic code, also encode the LukAB antibody heavy chain and light chain polypeptides described herein are also encompassed by the present disclosure. Such nucleic acid molecules may share 80%, 85%, 90%, or 95% sequence identity to the sequences of SEQ ID NOs: 834-997.

Suitable nucleic acid sequences (i.e., primary transcripts and coding DNA sequences (CDS)) encoding the LukE antibody heavy chain polypeptides and light chain polypeptides described herein are enumerated in Tables 30-33 and include SEQ ID NOs: 998-1045. Nucleic acid molecules having nucleotide sequences that differ from SEQ ID NOs: 998-1045, which as a result of the degeneracy of the genetic code, also encode the LukE antibody heavy chain and light chain polypeptides described herein are also encompassed by the present disclosure. Such nucleic acid molecules may share 80%, 85%, 90%, or 95% sequence identity to the sequences of SEQ ID NOs: 998-1045.

Suitable nucleic acid sequences (i.e., primary transcripts and coding DNA sequences (CDS)) encoding the LukD antibody heavy chain polypeptides and light chain polypeptides described herein are enumerated in Tables 34-37 and include SEQ ID NOs: 1046-1077. Nucleic acid molecules having nucleotide sequences that differ from SEQ ID NOs: 1046-1077, which as a result of the degeneracy of the genetic code, also encode the LukD antibody heavy chain and light chain polypeptides described herein are also encompassed by the present disclosure. Such nucleic acid molecules may share 80%, 85%, 90%, or 95% sequence identity to the sequences of SEQ ID NOs: 1046-1077.

Suitable nucleic acid sequences (i.e., primary transcripts and coding DNA sequences (CDS)) encoding the HlgA antibody heavy chain polypeptides and light chain polypeptides described herein are enumerated in Tables 38-41 and include SEQ ID NOs: 1078-1101. Nucleic acid molecules having nucleotide sequences that differ from SEQ ID NOs: 1078-1101, which as a result of the degeneracy of the genetic code, also encode the HlgA antibody heavy chain and light chain polypeptides described herein are also encompassed by the present disclosure. Such nucleic acid molecules may share 80%, 85%, 90%, or 95% sequence identity to the sequences of SEQ ID NOs: 1078-1101.

Suitable nucleic acid sequences (i.e., primary transcripts and coding DNA sequences (CDS)) encoding the HlgC antibody heavy chain polypeptides and light chain polypeptides described herein are enumerated in Tables 42-45 and include SEQ ID NOs: 1102-1125. Nucleic acid molecules having nucleotide sequences that differ from SEQ ID NOs: 1102-1125, which as a result of the degeneracy of the genetic code, also encode the HlgC antibody heavy chain and light chain polypeptides described herein are also encompassed by the present disclosure. Such nucleic acid molecules may share 80%, 85%, 90%, or 95% sequence identity to the sequences of SEQ ID NOs: 1102-1125.

Suitable nucleic acid sequences (i.e., primary transcripts and coding DNA sequences (CDS)) encoding LukE/HlgA antibody heavy chain polypeptides and light chain polypeptides described herein are enumerated in Tables 46-49 and include SEQ ID NOs: 1126-1281. Nucleic acid molecules having nucleotide sequences that differ from SEQ ID NOs: 1126-1281, which as a result of the degeneracy of the genetic code, also encode the LukE/HgA antibody heavy chain and light chain polypeptides described herein are also encompassed by the present disclosure. Such nucleic acid molecules may share 80%, 85%, 90%, or 95% sequence identity to the sequences of SEQ ID NOs: 1126-1281.

Another embodiment of the disclosure is directed to one or more vectors comprising nucleic acid sequence(s) encoding the *S. aureus* antibodies or binding portions thereof as described herein. The nucleotide sequences encoding the heavy and light chain variable domains, Fab fragments, or full-length chains of the antibodies disclosed herein are combined with sequences of promoter, translation initiation, 3' untranslated region, polyadenylation, and transcription termination to form one or more expression vector constructs.

In accordance with this embodiment, the expression vector construct encoding the *S. aureus* antibody or binding portion thereof can include the nucleic acid encoding the heavy chain polypeptide, a fragment thereof, a variant thereof, or combinations thereof. The heavy chain polypeptide can include a variable heavy chain (VH) region and/or at least one constant heavy chain (CH) region. The at least one constant heavy chain region can include a constant heavy chain region 1 (CH1), a constant heavy chain region 2 (CH2), and a constant heavy chain region 3 (CH3), and/or a hinge region. In some embodiments, the heavy chain polypeptide can include a VH region and a CH1 region. In other embodiments, the heavy chain polypeptide can include a VH region, a CH1 region, a hinge region, a CH2 region, and a CH3 region.

The expression construct can also include a nucleic acid sequence encoding the light chain polypeptide, a fragment thereof, a variant thereof, or combinations thereof. The light chain polypeptide can include a variable light chain (VL) region and/or a constant light chain (CL) region.

In one embodiment, the expression construct includes a nucleic acid sequence encoding a LukAB antibody or binding fragment thereof as described herein. Suitable nucleic acid sequences (i.e., primary transcripts and coding DNA sequences (CDS)) encoding the LukAB antibody heavy chain polypeptides and light chain polypeptides described herein are enumerated in Tables 26-29 and include SEQ ID NOs: 834-997.

In one embodiment, the expression construct includes a nucleic acid sequence encoding a LukE antibody or binding fragment thereof as described herein. Suitable nucleic acid sequences (i.e., primary transcripts and coding DNA sequences (CDS)) encoding the LukE antibody heavy chain polypeptides and light chain polypeptides described herein are enumerated in Tables 30-33 and include SEQ ID NOs: 998-1045.

In one embodiment, the expression construct includes a nucleic acid sequence encoding a LukD antibody or binding fragment thereof as described herein. Suitable nucleic acid sequences (i.e., primary transcripts and coding DNA sequences (CDS)) encoding the LukD antibody heavy chain polypeptides and light chain polypeptides described herein are enumerated in Tables 34-37 and include SEQ ID NOs: 1046-1077.

In one embodiment, the expression construct includes a nucleic acid sequence encoding a HlgA antibody or binding fragment thereof as described herein. Suitable nucleic acid sequences (i.e., primary transcripts and coding DNA sequences (CDS)) encoding the HlgA antibody heavy chain polypeptides and light chain polypeptides described herein are enumerated in Tables 38-41 and include SEQ ID NOs: 1078-1101

In one embodiment, the expression construct includes a nucleic acid sequence encoding a HlgC antibody or binding fragment thereof as described herein. Suitable nucleic acid sequences (i.e., primary transcripts and coding DNA sequences (CDS)) encoding the HlgC antibody heavy chain polypeptides and light chain polypeptides described herein are enumerated in Tables 42-45 and include SEQ ID NOs: 1102-1125.

In one embodiment, the expression construct includes a nucleic acid sequence encoding a LukE/HlgA antibody or binding fragment thereof as described herein. Suitable nucleic acid sequences (i.e., primary transcripts and coding DNA sequences (CDS)) encoding LukE/HlgA antibody heavy chain polypeptides and light chain polypeptides described herein are enumerated in Tables 46-49 and include SEQ ID NOs: 1126-1281.

The expression construct also typically comprises a promoter sequence suitable for driving expression of the antibody or binding fragment thereof. Suitable promoter sequences include, without limitation, the elongation factor 1-alpha promoter (EF1a) promoter, a phosphoglycerate kinase-1 promoter (PGK) promoter, a cytomegalovirus immediate early gene promoter (CMV), a chimeric liver-specific promoter (LSP) a cytomegalovirus enhancer/chicken beta-actin promoter (CAG), a tetracycline responsive promoter (TRE), a transthyretin promoter (TTR), a simian virus 40 promoter (SV40) and a CK6 promoter. Other promoters suitable for driving gene expression in mammalian cells that are known in the art are also suitable for incorporation into the expression constructs disclosed herein.

The expression construct can further encode a protease cleavage site. The protease cleavage site can be recognized by a protease or peptidase. The protease can be an endopeptidase or endoprotease, for example, but not limited to, furin, elastase, HtrA, calpain, trypsin, chymotrypsin, trypsin, and pepsin. In other embodiments, the protease can be a serine protease, a threonine protease, cysteine protease, aspartate protease, metalloprotease, glutamic acid protease, or any protease that cleaves an internal peptide bond (i.e., does not cleave the N-terminal or C-terminal peptide bond). The protease cleavage site can include one or more amino acid sequences that promote or increase the efficiency of cleavage.

The expression construct can further encode a linker sequence. The linker sequence can encode an amino acid sequence that spatially separates and/or links the one or more components of the expression construct (heavy chain and light chain components of the encoded antibody).

In one embodiment, a first expression vector construct encodes the heavy chain polypeptide that includes VH and CH1, and a second expression vector construct encodes the light chain polypeptide that includes VL and CL. An alternative arrangement include a first vector encoding the heavy chain polypeptide that includes VH, CH1, hinge region, CH2, and CH3, and the second vector encoding the light chain polypeptide that includes VL and CL.

In another embodiment, the expression vector construct encodes the heavy chain polypeptide that includes VH and CH1, and the light chain polypeptide that includes VL and CL, and a linker sequence is positioned between the nucleic acid sequence encoding the heavy chain polypeptide and the nucleic acid sequence encoding the light chain polypeptide.

In an alternative embodiment, the expression vector construct encodes the heavy chain polypeptide that includes VH and CH1, and the light chain polypeptide that includes VL and CL, and a nucleic acid sequence encoding a protease cleavage site is positioned between the nucleic acid sequence encoding the heavy chain polypeptide and the nucleic acid sequence encoding the light chain polypeptide.

In a further embodiment, the expression vector construct encodes the heavy chain polypeptide that includes VH, CH1, hinge region, CH2, and CH3, and the light chain polypeptide that includes VL and CL, and a linker sequence is positioned between the nucleic acid sequence encoding the heavy chain polypeptide and the nucleic acid sequence encoding the light chain polypeptide.

In yet another embodiment, the expression vector construct encodes the heavy chain polypeptide that includes VH, CH1, hinge region, CH2, and CH3, and the light chain polypeptide that includes VL and CL, and a heterologous nucleic acid sequence encoding the protease cleavage site is positioned between the nucleic acid sequence encoding the heavy chain polypeptide and the nucleic acid sequence encoding the light chain polypeptide.

In accordance with this aspect of the disclosure, the nucleic acid molecules encoding the S. aureus antibodies and binding fragments thereof can be incorporated into any expression vector capable of expressing the heavy chain polypeptide and/or light chain polypeptide encoded by the nucleic acid sequence construct. Suitable vectors include, e.g. a plasmid, a linear nucleic acid, and a viral vector.

In one embodiment, the expression vector is a circular plasmid (see, e.g., Muthumani et al., "Optimized and Enhanced DNA Plasmid Vector Based In vivo Construction of a Neutralizing anti-HIV-1 Envelope Glycoprotein Fab," Hum. Vaccin. Immunother. 9: 2253-2262 (2013), which is hereby incorporated by reference in its entirety). Plasmids can transform a target cell by integration into the cellular genome or exist extrachromosomally (e.g., autonomous replicating plasmid with an origin of replication). Exemplary plasmid vectors include, without limitation, pCEP4, pREP4, pVAX, pcDNA3.0, provax, or any other expression vector capable of expressing the heavy chain polypeptide and/or light chain polypeptide encoded by the recombinant nucleic acid sequence construct.

In another embodiment, the expression vector is a linear expression cassette ("LEC"). LECs are capable of being efficiently delivered to a subject via electroporation to express the heavy chain polypeptide and/or light chain polypeptide encoded by the recombinant nucleic acid sequence construct. The LEC may be any linear DNA devoid of a phosphate backbone. In one embodiment, the LEC does not contain any antibiotic resistance genes and/or a phosphate backbone. In another embodiment, the LEC does not contain other nucleic acid sequences unrelated to the desired gene expression.

The LEC may be derived from any plasmid capable of being linearized. The plasmid may be capable of expressing the heavy chain polypeptide and/or light chain polypeptide encoded by the recombinant nucleic acid sequence construct. Exemplary plasmids include, without limitation, pNP (Puerto Rico/34), pM2 (New Caledonia/99), WLV009, pVAX, pcDNA3.0, or provax, or any other expression vector capable of expressing the heavy chain polypeptide and/or light chain polypeptide encoded by the recombinant nucleic acid sequence construct.

In another embodiment, the expression vector is a viral vector. Suitable viral vectors that are capable of expressing full length antibodies or binding portions thereof include, for example, an adeno-associated virus (AAV) vector (See, e.g., Lewis et al., "Generation of Neutralizing Activity against Human Immunodeficiency Virus Type I in Serum by Antibody Gene Transfer," J. Virol. 76:8769-775 (2002); Fang et al., "An Antibody Delivery System for Regulated Expression of Therapeutic Levels of Monoclonal Antibodies In vivo," Mol. Ther. 15(6): 1153-9 (2007); Buning et al, "Recent Developments in Adeno-associated Virus Vector Technology," J. Gene Med. 10:717-733 (2008), each of which is incorporated herein by reference in its entirety), a lentivirus vector (See, e.g., U.S. Pat. No. 748,529 to Fang et al.; Joseph et al., "Inhibition of In vivo HIV Infection in Humanized Mice by Gene Therapy of Human Hematopoietic Stem Cells with a Lentiviral Vector Encoding a Broadly Neutralizing anti-HIV Antibody," J. Virol., 84: 6645-53 (2010); and Luo et al., "Engineering Human Hematopoietic Stem/Progenitor Cells to Produce a Broadly Neutralizing anti-HIV Antibody after In vivo Maturation to Human B Lymphocytes," Blood 113: 1422-1431 (2009), which are hereby incorporated by reference in their entirety), a retrovirus vector (See e.g., U.S. Pat. No. 748,529 to Fang et al., which is hereby incorporated by reference in its entirety), a replication deficient adenovirus vector and a gutless adenovirus vector (See e.g., U.S. Pat. No. 5,872,005, which is incorporated herein by reference in its entirety). Methods for generating and isolating adeno-associated viruses (AAVs) suitable for use as vectors are known in the art (see, e.g., Grieger & Samulski, "Adeno-associated Virus as a Gene Therapy Vector: Vector Development, Production and Clinical Applications," Adv. Biochem. EnginBiotechnol. 99: 119-145 (2005); Buning et al, "Recent Developments in Adeno-associated Virus Vector Technology," J. Gene Med. 10:717-733 (2008), each of which is incorporated herein by reference in its entirety.

Another aspect of the present disclosure is directed to a host cell comprising a vector containing a polynucleotide encoding an antibody or binding portion thereof as described herein. The heavy and light chain expression constructs can be co-transfected, serially transfected, or separately transfected into host cells which are then fused to form a single host cell expressing both chains. The antibodies and binding portions thereof described herein can optionally be produced by a cell line, a mixed cell line, an immortalized cell or clonal population of immortalized cells, as well known in the art (see e.g., Ausubel et al., ed., Current Protocols in Molecular Biology, John Wiley & Sons, Inc., NY, N.Y. (1987-2001); Sambrook et al., Molecular Cloning: A Laboratory Manual, $2^{nd}$ Edition, Cold Spring Harbor, N.Y. (1989); Harlow and Lane, Antibodies, a Laboratory Manual, Cold Spring Harbor, N.Y. (1989); Colligan et al., eds., Current Protocols in Immunology, John Wiley & Sons, Inc., NY (1994-2001); Colligan et al., Current Protocols in Protein Science, John Wiley & Sons, NY, N.Y., (1997-2001), which are hereby incorporated by reference in their entirety). Such host cells may be eukaryotic cells, bacterial cells, plant cells or archeal cells. Exemplary eukaryotic cells may be of mammalian, insect, avian or other animal origins. Mammalian eukaryotic cells include immortalized cell lines such as hybridomas or myeloma cell lines such as SP2/0 (American Type Culture Collection (ATCC), Manassas, Va., CRL-1581), NSO (European Collection of Cell Cultures (ECACC), Salisbury, Wiltshire, UK, ECACC No. 85110503), FO (ATCC CRL-1646) and Ag653 (ATCC CRL-1580) murine cell lines. An exemplary human myeloma cell line is U266 (ATTC CRL-TIB-196). Other useful cell lines include those derived from Chinese Hamster Ovary (CHO) cells such as CHO-K1SV (Lonza Biologics, Walkersville, Md.), CHO-K1 (ATCC CRL-61) or DG44.

The antibodies described herein can be prepared by any of a variety of techniques using the isolated polynucleotides, vectors, and host cells described supra. In general, antibodies can be produced by cell culture techniques, including the generation of monoclonal antibodies via conventional techniques, or via transfection of antibody genes, heavy chains and/or light chains into suitable bacterial or mammalian cell hosts, in order to allow for the production of antibodies, wherein the antibodies may be recombinant. Standard molecular biology techniques are used to prepare the recombinant expression vector, transfect the host cells, select for transformants, culture the host cells and recover the antibody from the culture medium. Transfecting the host cell can be carried out using a variety of techniques commonly used for the introduction of exogenous DNA into a prokaryotic or eukaryotic host cell, e.g., by electroporation, calcium-phosphate precipitation, DEAE-dextran transfection and the like. Although it is possible to express the antibodies described herein in either prokaryotic or eukaryotic host cells, expression of antibodies in eukaryotic cells is sometimes preferable, and sometimes preferable in mammalian host cells, because such eukaryotic cells (and in particular mammalian cells) are more likely than prokaryotic cells to assemble and secrete a properly folded and immunologically active antibody.

As noted above, exemplary mammalian host cells for expressing the recombinant antibodies of the invention include Chinese Hamster Ovary (CHO cells) (including dhfr-CHO cells, described in Urlaub and Chasin, Proc. Natl. Acad. Sci. USA, 77: 4216-4220 (1980), which is hereby incorporated by reference in its entirety). Other suitable mammalian host cells include, without limitation, NSO myeloma cells, COS cells, and SP2 cells. When recombinant expression vectors encoding antibody genes are introduced into mammalian host cells, the antibodies are produced by culturing the host cells for a period of time sufficient to allow for expression of the antibody in the host cells or, more preferably, secretion of the antibody into the culture medium in which the host cells are grown.

Host cells can also be used to produce functional antibody fragments, such as Fab fragments or scFv molecules. It is understood that variations on the above procedure are within the scope of the present disclosure. For example, it may be desirable to transfect a host cell with DNA encoding functional fragments of either the light chain and/or the heavy chain of an antibody described herein. Recombinant DNA technology may also be used to remove some or all of the DNA encoding either or both of the light and heavy chains that is not necessary for binding to the antigens of interest. The molecules expressed from such truncated DNA molecules are also encompassed by the antibodies described herein.

The antibodies and binding portions thereof as described herein can be post-translationally modified by processes such as glycosylation, isomerization, deglycosylation or non-naturally occurring covalent modification such as the addition of polyethylene glycol (PEG) moieties (pegylation) and lipidation. Such modifications may occur in vivo or in vitro. For example, the antibodies or binding portions thereof described herein can be conjugated to polyethylene glycol (PEGylated) to improve their pharmacokinetic profiles. Conjugation can be carried out by techniques known to those skilled in the art. Conjugation of therapeutic antibodies with PEG has been shown to enhance pharmacodynamics while not interfering with function (see e.g., Deckert et al., Int. J. Cancer 87:382-390 (2000); Knight et al., Platelets 15:409-418 (2004); Leong et al., Cytokine 16:106-119 (2001); Yang et al., Protein Eng. 16:761-770 (2003), which are hereby incorporated by reference in their entirety).

Pharmacokinetic properties of the antibodies of the invention can also be enhanced through Fc modifications by techniques known to those skilled in the art. As described supra, the "Fc" region of an antibody is not involved directly in binding of an antibody to an antigen, but exhibits various effector functions. An antibody "Fc" region is a term well known and is defined on the basis of papain cleavage of antibodies. The Fc region of an antibody is directly involved in ADCC (antibody-dependent cell-mediated cytotoxicity) and CDC (complement-dependent cytotoxicity) based on complement activation, Clq binding and Fc receptor binding. Complement activation (CDC) is initiated by binding of complement factor Clq to the Fc of most IgG antibody subclasses. While the influence of an antibody on the complement system is dependent on certain conditions, binding to Clq is caused by defined binding sites in the Fc region of the antibody. Such binding sites are known in art, and include, e.g., amino acid residues L234, L235, D270, N297, E318, K320, K322, P331, and P329 (numbering according to EU index of Kabat) (see e.g., Boakle et al., Nature 282: 742-43 (1979); Lukas et al., J. Immunol. 127: 2555-60 (1981); Brunhouse and Cebra, Mol. Immunol. 16: 907-17 (1979); Burton et al., Nature 288:338-44 (1980); Thommesen et al., Mol. Immunol. 37: 995-1004 (2000); Idusogie et al., J Immunol. 164:4178-84 (2000); Hezareh et al., J. Virology 75:12161-68 (2001); Morgan et al., Immunology 86:319-24 (1995), which are hereby incorporated by reference in their entirety). Modifications to one or more of these binding sites can be made to modify the effector functions of the antibodies or binding portions thereof as desired.

S. aureus can adversely affect standard IgG1-based monoclonal antibody (mAb) therapeutics either by directly cleaving the mAb, sequestering the mAb by Protein A or Sbi binding, or by killing off the very effector cells required for therapeutic efficacy. Therefore, in one embodiment, an antibody or binding fragment thereof as described herein, comprises one or more amino acid substitutions, insertions, and/or deletions that protect the antibody or binding fragment thereof from staph mediated cleavage and/or sequestration. For example, human IgG1 is susceptible to staph mediated cleavage in the lower hinge region, and this cleavage can result in a loss of Fc mediated effector function both in vitro and in vivo (Brezski et al., "Tumor-Associated and Microbial Proteases Compromise Host IgG Effector Functions by a Single Cleavage Proximal to the Hinge," *PNAS* 106:17864-17869 (2009), which is hereby incorporated by reference in its entirety. The *S. aureus* protease, GluV8, cleaves human IgG1 in the lower hinge region between amino acids E233 and L234, and it was previously demonstrated that this cleavage abrogates both ADCC and CDC function (Brezski et al., "Human Anti-IgG1 Hinge Autoantibodies Reconstitute the Effector Functions of Proteolytically Inactivated IgGs," *J. Immunol.* 181:3183-3192 (2008), which is hereby incorporated by reference in its entirety). Therefore, in one embodiment, the hinge region of an antibody disclosed herein is engineered to have increased resistance to proteolysis by GluV8. Suitable modifications include mutating the lower hinge region (E233P/L234V/L235A with G236 deleted) as disclosed in U.S. Patent Application Publication No. US20150210756 to Torres et al., which is hereby incorporated by reference in its entirety.

In another embodiment, the antibodies or binding fragments thereof comprise one or more amino acid substitutions, insertion, and/or deletions to decrease or prevent non-specific binding to other staphylococcal or host (e.g., human) protein antigens. For example, in one aspect, the antibody or binding fragment thereof is not capable of specific binding to staphylococcal Protein A or second binding protein for immunoglobulins (Sbi). In another aspect, the binding molecule is not capable of specific binding to FcγRI, in particular human FcγRI. In another aspect, the binding molecule does retain specific binding capacity to FcRn.

The antibodies and binding fragments thereof as described herein are preferably "isolated" antibodies. "Isolated" when used to describe the antibodies disclosed herein, means an antibody that has been identified, separated and/or recovered from a component of its production environment. Preferably, the isolated antibody is free of association with all other components from its production environment. Contaminant components of its production environment, such as that resulting from recombinant transfected cells, are materials that would typically interfere with diagnostic or therapeutic uses for the antibody, and may include enzymes, hormones, and other proteinaceous or non-proteinaceous solutes. The antibodies and antibody binding fragments are recovered and purified from recombinant cell cultures by known methods including, but not limited to, protein A purification, ammonium sulfate or ethanol precipitation, acid extraction, anion or cation exchange chromatography, phosphocellulose chromatography, hydrophobic interaction chromatography, affinity chromatography, hydroxylapatite chromatography and lectin chromatography. High performance liquid chromatography ("HPLC") can also be used for purification.

Antibody Compositions

Another aspect of the present disclosure is directed to a pharmaceutical composition comprising one or more *S. aureus* antibodies as described herein, or one or more nucleic acid molecules or expression vector constructs encoding the one or more *S. aureus* antibodies described herein, and a pharmaceutical carrier, as well as methods of treating and inhibiting the onset of a staphylococcal infection in a subject using these pharmaceutical compositions.

In one embodiment, the pharmaceutical composition of the present disclosure comprises a single antibody composition, i.e., the composition contains one type of an antibody binding to a particular epitope on a particular protein, e.g., a LukE antibody composition. In another embodiment, the pharmaceutical composition contains two or more different antibodies, each antibody binding to a different epitope of the same protein or to different epitopes of different staphylococcal bi-component toxin proteins. In another embodiment, the pharmaceutical composition comprises one or more antibodies as described herein in combination with one or more prophylactic or therapeutic agents other than the antibodies described herein that are useful for preventing or treating a staphylococcal infection.

The therapeutically effective amount of antibody present in the pharmaceutical composition or formulation is determined by taking into account the desired dose volumes and mode(s) of administration. Exemplary antibody concentrations in the pharmaceutical compositions of the present disclosure include from about 0.1 mg/mL to about 50 mg/mL, from about 0.5 mg/mL to about 25 mg/mL, and from about 2 mg/mL to about 10 mg/mL.

An aqueous formulation is prepared comprising the antibody in a pH-buffered solution. The buffer has a pH in the range from about 4.5 to about 10, from about 5 to about 9, or from about 6 to 8. Examples of buffers include phosphate buffers (e.g., phosphate buffered saline), acetate (e.g. sodium acetate), succinate (such as sodium succinate), gluconate, histidine, citrate and other organic acid buffers. A polyol, which acts as a tonicifier and may stabilize the antibody, may be included in the formulation. In one embodiment, the tonicifying polyol is a salt such as sodium chloride. In another embodiment, the polyol is a nonreducing sugar, such as sucrose or trehalose. The polyol is added to the formulation in an amount which may vary with respect to the desired isotonicity of the formulation. Preferably the aqueous formulation is isotonic, in which case suitable concentrations of the polyol in the formulation are in the range from about 1% to about 15% w/v, or in the range from about 2% to about 10% w/v, for example. However, hypertonic or hypotonic formulations may also be suitable. The amount of polyol added may also alter with respect to the molecular weight of the polyol. For example, a lower amount of a monosaccharide (e.g. mannitol) may be added, compared to a disaccharide (such as trehalose).

In one embodiment, the pharmaceutical composition contains the above-identified agents (i.e. antibody, buffer, polyol) and is essentially free of one or more preservatives, such as benzyl alcohol, phenol, m-cresol, chlorobutanol and benzethonium Cl. In another embodiment, a preservative may be included in the pharmaceutical composition, particularly where the formulation is a multidose formulation. Suitable preservatives include, without limitation phenol, m-cresol, p-cresol, o-cresol, chlorocresol, benzyl alcohol, phenylmercuric nitrite, phenoxyethanol, formaldehyde, chlorobutanol, magnesium chloride (e.g., hexahydrate), alkylparaben (methyl, ethyl, propyl, butyl and the like), benzalkonium chloride, benzethonium chloride, sodium dehydroacetate and thimerosal, or mixtures thereof in an aqueous diluent. The concentration of preservative may be in the range from about 0.01% to about 5%, from about 0.5% to about 2% and any range or value therein. One or more other pharmaceutically acceptable carriers, excipients or stabilizers such as those described in *Remington's Pharma-* ceutical Sciences 16th edition, Osol, A. Ed. (1980) may be included in the composition provided that they do not adversely affect the desired characteristics of the formulation. Acceptable carriers, excipients or stabilizers are non-toxic to recipients at the dosages and concentrations employed and include; additional buffering agents; co-solvents; antioxidants including ascorbic acid and methionine; chelating agents such as EDTA; metal complexes (e.g. Zn-protein complexes); biodegradable polymers such as polyesters; and/or salt-forming counterions such as sodium.
Methods of Use The staphylococcal bi-component antibodies and binding portions thereof, or pharmaceutical compositions containing the same, can be used for the treatment, prevention or amelioration of a staphylococcal infection. The staphylococcal infection may be caused by any *Staphylococcus* spp. In one aspect, the staphylococcal infection is caused by *Staphylococcus aureus*, including methicillin-resistant *S. aureus* (MRSA) and methicillin-sensitive *S. aureus* (MSSA). Accordingly, the present disclosure provides a method for the treatment, prevention or amelioration of a staphylococcal infection that involves administering to a subject in need thereof a one or more of the antibodies or binding portions described herein or a pharmaceutical composition containing the same as described herein.

In accordance with this aspect, a "subject" suitable for treatment with the antibodies and compositions described herein includes any animal, for example, a mammal, such as a human. In the context of administering an antibody composition as described herein for purposes of preventing or inhibiting the onset of a staphylococcal infection in a subject, the subject encompasses any subject that is at risk of becoming infected with *staphylococcus* or developing a staphylococcal infection. Susceptible subjects include infants and juveniles, as well as immunocompromised juvenile, adults, and elderly adults. However, any infant, juvenile, adult, or elderly adult or immunocompromised individual at risk for developing a staphylococcal infection can be treated in accordance with the methods described herein. In the context of administering an antibody composition as described herein for purposes of treating a staphylococcal infection in a subject, the subject encompasses any subject infected with *staphylococcus*. Particularly suitable subjects include those at risk of infection, susceptible to infection, or those infected with methicillin-resistant *S. aureus* (MRSA) or methicillin sensitive *S. aureus* (MSSA). Other suitable subjects include those subjects which may have or are at risk for developing a condition resulting from a *staphylococcus* infection, i.e., a staphylococcal associated condition, such as, for example, skin wounds and infections, tissue abscesses, folliculitis, osteomyelitis, pneumonia, scalded skin syndrome, septicemia, septic arthritis, myocarditis, endocarditis, and toxic shock syndrome.

In one embodiment, the antibodies or binding portions thereof, or pharmaceutical compositions containing the same, are administered prophylactically to prevent, delay, or inhibit the onset or development of staphylococcal infection in a subject at risk of developing a staphylococcal infection or associated condition. In one aspect, prophylactic administration of one or antibodies or binding portions thereof as described herein is effective to fully prevent *S. aureus* infection in an individual. In other embodiments, prophylactic administration is effective to prevent the full extent of infection that would otherwise develop in the absence of such administration, i.e., substantially prevent, inhibit, or minimize staphylococcal infection in an individual.

In another embodiment, the antibodies, binding portions thereof, or pharmaceutical compositions containing the same as described herein are administered therapeutically to an individual having a staphylococcal infection to inhibit the progression and further development of the infection, i.e., to inhibit and/or prevent the spread of the infection to other cells in an individual, decrease infection, and to treat or alleviate one or more symptoms of infection.

Therapeutically effective amounts of the antibodies or binding portions thereof as described herein are determined in accordance with standard procedures, which take numerous factors into account, including, for example, the concentrations of the antibodies or binding portions thereof in a pharmaceutical composition, the mode and frequency of administration, the severity of the *staphylococcus* infection to be treated (or prevented), and subject details, such as age, weight and overall health and immune condition. General guidance can be found, for example, in the publications of the International Conference on Harmonization and in REMINGTON'S PHARMACEUTICAL SCIENCES (Mack Publishing Company 1990), which is hereby incorporated by reference in its entirety. A clinician may administer a composition comprising the antibodies or binding portions thereof as described herein in a single dose or in accordance with a multi-dosing protocol until a dosage is reached that provides the desired or required prophylactic or therapeutic effect. The progress of this therapy can be easily monitored by conventional assays. In prophylactic applications, a relatively low dosage is administered at relatively infrequent intervals over a long period of time. In therapeutic applications, a relatively high dosage at relatively short intervals (e.g., as little as 15 minutes, 30 minutes, 60 minutes, 90 minutes or even 2 or 3 hours) is sometimes required until progression of the infection is reduced or terminated, and preferably until the subject shows partial or complete amelioration of symptoms of infection.

The therapeutically effective amount, i.e., the dosage that is sufficient to slow or prevent the spread or severity of staphylococcal infection in a subject, and/or the dosage sufficient to prevent, alleviate (either partially or completely) a staphylococcal infection associated condition. Such therapeutically effective amounts vary by individual, but may range from 0.1 to 10 mg/kg body weight, for example 1, 2, 3, 4, 5, 6, 7, 8, 9 or 10 mg/kg, but may be even higher, for example 15, 20, 30, 40, 50, 60, 70, 80, 90 or 100 mg/kg. A fixed unit dose may also be given, for example, 50, 100, 200, 500 or 1000 mg, or the dose may be based on the patient's surface area, e.g., 400, 300, 250, 200, or 100 mg/m². Usually between 1 and 8 doses, (e.g., 1, 2, 3, 4, 5, 6, 7 or 8) may be administered to treat infection, but 10, 15, 20 or more doses may be given depending on the severity of infection. Administration of antibodies or binding portions thereof of the present invention may be repeated after one day, two days, three days, four days, five days, six days, one week, two weeks, three weeks, one month, five weeks, six weeks, seven weeks, two months, three months, four months, five months, six months or longer. Repeated courses of treatment are also possible, as is chronic administration. The repeated administration may be at the same dose or at a different dose.

The therapeutic compositions of the present invention can be administered alone or as part of a combination therapy in conjunction with one or more other active agents, depending upon the nature of the *staphylococcus* infection that is being treated. Such additional active agents include anti-infective agents, antibiotic agents, and antimicrobial agents that are readily known in the art.

The mode of administration of the antibodies or binding portions thereof or pharmaceutical compositions described herein may be any suitable route that delivers the antibodies or binding portions thereof to the host, such as parenteral administration, e.g., intradermal, intramuscular, intraperitoneal, intravenous or subcutaneous; inhalation administration; transmucosal administration (oral, intranasal, intravaginal, rectal); or enteral administration. The pharmaceutical composition can be formulated in a tablet, capsule, solution, powder, gel, particle; and/or contained in a syringe, an implanted device, osmotic pump, cartridge, micropump; or other means appreciated by the skilled artisan, as well known in the art. Site specific administration may be achieved by, for example, intrarticular, intrabronchial, intraabdominal, intracapsular, intracartilaginous, intracavitary, intracelial, intracerebellar, intracerebroventricular, intracolic, intracervical, intragastric, intrahepatic, intracardial, intraosteal, intrapelvic, intrapericardiac, intraperitoneal, intrapleural, intraprostatic, intrapulmonary, intrarectal, intrarenal, intraretinal, intraspinal, intrasynovial, intrathoracic, intrauterine, intravascular, intravesical, intralesional, vaginal, rectal, buccal, sublingual, intranasal, or transdermal delivery.

In another embodiment, a pharmaceutical composition comprising a recombinant nucleic acid sequence encoding an antibody or binding portion thereof as described herein, is administered to a subject to facilitate in vivo expression and formation of the antibody as a prophylactic therapy for the treatment or prevention of staphylococcal infection in a subject. Expression vector constructs suitable for use in this embodiment of the disclosure are described supra, and nucleic acid sequences encoding the staphylococcal antibodies described herein are provided herein in Tables 26-49 (SEQ ID NOs: 834-1281).

The composition can result in the generation of the antibody in the subject within at least about 1 hour, 2 hours, 3 hours, 4 hours, 5 hours, 6 hours, 7 hours, 8 hours, 9 hours, 10 hours, 11 hours, 12 hours, 13 hours, 14 hours, 15 hours, 20 hours, 25 hours, 30 hours, 35 hours, 40 hours, 45 hours, 50 hours, or 60 hours of administration of the composition to the subject. The composition can result in generation of the synthetic antibody in the subject within at least about 1 day, 2 days, 3 days, 4 days, 5 days, 6 days, 7 days, 8 days, 9 days, or 10 days of administration of the composition to the subject. The composition can result in generation of the antibody in the subject within about 1 hour to about 6 days, about 1 hour to about 5 days, about 1 hour to about 4 days, about 1 hour to about 3 days, about 1 hour to about 2 days, about 1 hour to about 1 day, about 1 hour to about 72 hours, about 1 hour to about 60 hours, about 1 hour to about 48 hours, about 1 hour to about 36 hours, about 1 hour to about 24 hours, about 1 hour to about 12 hours, or about 1 hour to about 6 hours of administration of the composition to the subject.

The composition, when administered to the subject in need thereof, can result in the persistent generation of the antibody in the subject. The composition can result in the generation of the antibody in the subject for at least about 1 day, 2 days, 3 days, 4 days, 5 days, 6 days, 7 days, 8 days, 9 days, 10 days, 11 days, 12 days, 13 days, 14 days, 15 days, 16 days, 17 days, 18 days, 19 days, 20 days, 21 days, 22 days, 23 days, 24 days, 25 days, 26 days, 27 days, 28 days, 29 days, 30 days, 31 days, 32 days, 33 days, 34 days, 35 days, 36 days, 37 days, 38 days, 39 days, 40 days, 41 days, 42 days, 43 days, 44 days, 45 days, 46 days, 47 days, 48 days, 49 days, 50 days, 51 days, 52 days, 53 days, 54 days, 55 days, 56 days, 57 days, 58 days, 59 days, or 60 days.

As described supra, the expression vector construct can include the nucleic acid encoding a staphylococcal antibody heavy chain polypeptide, a fragment thereof, a variant thereof, or a combination thereof. The heavy chain polypeptide can include a variable heavy chain (VH) region and/or at least one constant heavy chain (CH) region. The at least one constant heavy chain region can include a constant heavy chain region 1 (CH1), a constant heavy chain region 2 (CH2), and a constant heavy chain region 3 (CH3), and/or a hinge region.

The expression vector construct can also include the nucleic acid sequence encoding the corresponding staphylococcal antibody light chain polypeptide, a fragment thereof, a variant thereof, or a combination thereof. The light chain polypeptide can include a variable light chain (VL) region and/or a constant light chain (CL) region.

In one embodiment, the composition comprises an expression vector construct encoding a LukAB antibody or binding fragment thereof as described herein. Suitable nucleic acid sequences encoding the LukAB antibody heavy chain polypeptides and light chain polypeptides described herein are enumerated in Tables 26-29 and include SEQ ID NOs: 834-997.

In one embodiment, the composition comprises an expression vector construct encoding a LukE antibody or binding fragment thereof as described herein. Suitable nucleic acid sequences encoding the LukE antibody heavy chain polypeptides and light chain polypeptides described herein are enumerated in Tables 30-33 and include SEQ ID NOs: 998-1045.

In one embodiment, the composition comprises an expression vector construct encoding a LukD antibody or binding fragment thereof as described herein. Suitable nucleic acid sequences encoding the LukD antibody heavy chain polypeptides and light chain polypeptides described herein are enumerated in Tables 34-37 and include SEQ ID NOs: 1046-1077.

In one embodiment, the composition comprises an expression construct encoding a HlgA antibody or binding fragment thereof as described herein. Suitable nucleic acid sequences encoding the HlgA antibody heavy chain polypeptides and light chain polypeptides described herein are enumerated in Tables 38-41 and include SEQ ID NOs: 1078-1101.

In one embodiment, the composition comprises an expression construct encoding a HlgC antibody or binding fragment thereof as described herein. Suitable nucleic acid sequences encoding the HlgC antibody heavy chain polypeptides and light chain polypeptides described herein are enumerated in Tables 42-45 and include SEQ ID NOs: 1102-1125.

In one embodiment, the composition comprises an expression construct encoding a LukE/HlgA antibody or binding fragment thereof as described herein. Suitable nucleic acid sequences encoding LukE/HlgA antibody heavy chain polypeptides and light chain polypeptides described herein are enumerated in Tables 46-49 and include SEQ ID NOs: 1126-1281.

Upon expression of the first and/or second vectors described above, in, for example, but not limited to, a mammalian subject, the heavy chain polypeptide and the light chain polypeptide assemble into the antibody. In particular, the heavy chain polypeptide and the light chain polypeptide interact with one another such that assembly results in the antibody being capable of binding the desired staphylococcal bi-component toxin (i.e., LukAB, LukE, LukD, HlgA, HlgC, or LukE/HlgA), and exerting its desired biological effect, e.g., neutralization. In still other embodiments, the heavy chain polypeptide and the light chain polypeptide interact with one another such that assembly results in the antibody being capable of eliciting or inducing an immune response against the antigen.

The expression vector constructs of the invention may be introduced into cells in vitro or ex vivo using standard methodology known in the art. Such techniques include transfection using calcium phosphate, micro-injection into cells (see, e.g., Capecchi, Cell 22:479-488 (1980), which is hereby incorporated by reference in its entirety), electroporation (see, e.g., Shigekawa et al., *BioTechn.* 6:742-751 (1988), which is hereby incorporated by reference in its entirety), liposome-mediated gene transfer (see, e.g., Mannino et al., *BioTechn.* 6:682-690 (1988), which is hereby incorporated by reference in its entirety), lipid-mediated transduction (see, e.g., Felgner et al., *Proc. Natl. Acad. Sci. USA* 84:7413-7417 (1987), which is hereby incorporated by reference in its entirety), and nucleic acid delivery using high-velocity microprojectiles (see, e.g., Klein et al., *Nature* 327:70-73 (1987), which is hereby incorporated by reference in its entirety).

The vectors may be administered in vivo via various routes (e.g., intradermally, intravenously, intraportally, intraperitoneally, intramuscularly, etc.), to deliver the expression vector construct for antibody expression. Dependent upon the route of administration, the antibodies elicit their effect locally or systemically.

Another aspect of the present disclosure is directed to the use of the antibodies and binding portions thereof as provided herein to detect *staphylococcus* in a biological sample, such as a blood, tissue, cell, serum, sputum, or other biological sample. In accordance with this embodiment, the antibodies or binding portions thereof can be used in methods of diagnosing a staphylococcal infection in a subject (animal or human). In one aspect, the method for diagnosing a staphylococcal infection involves contacting an antibody or binding portion thereof as described herein with a sample from the subject to be diagnosed, and detecting at least the presence or the absence of one or more staphylococcal bi-component toxins in the sample. The subject is diagnosed as having a staphylococcal infection based on detecting the presence of one or more bi-component toxins in the sample.

Methods described herein involving the detection of a staphylococcal leukotoxin and/or gamma hemolysin alone or in combination with each other, in a sample from a subject or elsewhere, involve the use of a detectably labeled antibody or binding portion thereof. Accordingly, in one aspect the antibody or binding portion thereof as described herein may be coupled to a detectable label. Suitable detectable labels are well known in the art and include detectable tags (e.g., a poly-histidine (His6-) tag, a glutathione-S-transferase (GST-) tag, or a maltose-binding protein (MBP-) tag); radioactive labels (e.g., carbon (14C) or phosphorous (32P)); fluorescent labels (e.g., fluorescein and derivatives thereof, fluorescein isothiocyanate, rhodamine and derivatives thereof, dichlorotriazinylamine fluorescein, dansyl chloride or phycoerythrin); luminescent labels (e.g., luminol); bioluminescent labels (e.g., luciferase, luciferin, and aequorin); or enzymatic labels (e.g., luciferin, 2,3-dihydrophthalazinediones, malate dehydrogenase, urease, peroxidases (e.g., horseradish peroxidase), alkaline phosphatase, β-galactosidase, glucoamylase, lysozyme, saccharide oxidases (e.g., glucose oxidase, galactose oxidase, and glucose-6-phosphate dehydrogenase), heterocyclic oxidases (e.g., uricase and xanthine oxidase), lactoperoxidase, microperoxidase). Alternatively, these diagnostic methods involve the use of secondary reagents useful for detectably labeling the antibody or binding portion thereof. In these embodiments, the secondary antibody, which binds to the anti-leukotoxin antibody or binding portion thereof, is coupled to a detectable label, such as any of the aforementioned detectable labels.

Detection assays for detecting the labeled antibody or a binding portion thereof bound to a staphylococcal leukotoxin and/or gamma hemolysin in a sample are well known in the art and include, for example, immunoprecipitation, direct and indirect sandwich assays, competitive binding assays, enzyme-linked immunosorbent assays (ELISA), radioimmunoassays (RIA), or fluorescent activated cell sorting (FACS).

The presence or the absence of one or more staphylococcal bi-component toxins in a sample can also be detected using two antibodies or binding portions thereof as described herein, which bind to non-competing epitopes on the staphylococcal bi-component toxin. For example, a double-sandwich ELISA allows for the detection of multiple epitopes using a first antibody as a capture antibody and a second antibody as a detection antibody (see, e.g., Ding et al., "Development of a Double Antibody Sandwich ELISA for West Nile Virus Detection Using Monoclonal Antibodies against Non-Structural Protein 1," *PLoS One* 9(10): e108623, which is hereby incorporated by reference in its entirety).

The diagnostic antibodies and binding fragments thereof may be used to detect *S. aureus* bi-component toxins in any biological samples, including, without limitation tissue extracts, urine, blood, serum, stool, and phlegm. Biological samples that *S. aureus* leukotoxins may be detected using the antibodies or binding fragments thereof.

Another aspect of the present disclosure is directed to a diagnostic kit containing one or more of the *S. aureus* bi-component toxin antibodies as described herein. The kit can also include a detectable label. The diagnostic antibody itself may contain the detectable label (e.g., fluorescent molecule, biotin, etc.) which is directly detectable or detectable via a secondary reaction (e.g., reaction with strepavidin). Alternatively, a second reagent containing the detectable label may be utilized, where the second reagent has binding specificity for the primary antibody. In a diagnostic kit suitable for measuring *S. aureus* in a biological sample, the antibodies of the kit may be supplied prebound to a solid phase, such as to the wells of a microtiter dish.

EXAMPLES

Examples are provided below to illustrate the present invention. These examples are not meant to constrain the present invention to any particular application or theory of operation Examples 1—Antibody Generation Immunizations were performed with five antigens in six mouse immunization campaigns as described herein.

LukAB Antibody Generation.

Two separate cohorts of Balb/c and C3H mice received three or four intraperitoneal (i.p.) injections of a recombinant toxoid variant of the LukAB protein (LukA E323A) (DuMont et al., "Identification of a Crucial Residue Required for *Staphylococcus aureus* LukAB Cytotoxicity and Receptor Recognition," *Infect Immun.* 82(3):1268-76 (2014), which is hereby incorporated by reference in its entirety)—herein referred to as LukA'B protein) mixed with either Complete (Sigma catalog #F5881) or Incomplete (Sigma catalog #F5506) Freund's adjuvant over the course of 7 to 8 weeks. Immune titers were tested at an intermediate time point, and all mice had titers of at least 128,000. Titer is defined as the greatest sera dilution at which anti-LukA'B antibodies could be detected above background by ELISA. At the end of the 7-8 week period, animals were injected subcutaneously (s.q.) at the base of the tail (B.O.T.) with LukA'B protein and an agonistic anti-mouse-CD40 mAb (R&D Systems catalog #MAB440) diluted in DPBS. Four days after the B.O.T injection, spleens were harvested, homogenized, and a B cell enriched fraction was isolated by Magnetic Activated Cell Sorting (MACS). B cells and FO mouse myeloma cells were co-incubated in a polyethylene glycol (PEG)-4000 solution to generate mAb secreting hybridomas cell lines. Following 10 days of hybridoma growth, hybridoma conditioned media was added to assay plates coated with LukA'B protein, and ELISA was performed to identify hybridomas that produce LukA'B binding mAbs. Hybridoma media samples positive for binding to LukA'B were subsequently screened by ELISA to identify samples specific to LukA'B, which exhibited no detectable binding to LukD, LukS-PV, LukE, HlgA, or HlgC.

The immunoglobulin heavy chain (HC) and (LC) genes were cloned from the hybridoma cells by RT-PCR, followed by cDNA synthesis. For HC and LC RT-PCR, pools of primers complementary to v-region framework 1 (FR1) and single primers complementary to a region of constant domain 1 (CD1) were used. From this point, HC and LC expression plasmids were made by one of two methods. For the first method, double stranded HC and LC cDNA fragments were ligated into plasmids to enable sequencing and expression of full length murine LC and HC (IgG1 isotype). LC and HC plasmids were transformed into competent E. coli, multiple colonies per chain were picked, and the LC and HC genes were sequenced. Plasmid DNA for the consensus sequence for each chain was prepared for mAb protein expression. For the second method of HC and LC expression plasmid generation, cDNA fragments were sequenced by Next Generation Sequencing. Following sequencing, a panel of mAb HC and LC sequences were selected for de novo gene synthesis based upon quality of the sequencing data, sequence redundancy, and predicted mAb expression risks (i.e. mAb sequences with known post-translational liabilities were excluded). De novo gene synthesis was performed to generate plasmid DNA for mAb protein expression.

Expi293F cells were co-transfected with cognate LC and HC expressing plasmid pairs using Gibco's Expifectamine transfection fit. Culture supernatants were harvested 5 days later, and the mAb concentrations were determined. The recombinantly expressed mAbs were re-tested by ELISA for binding to all six of the aforementioned leukotoxins or subunits thereof to validate mAbs that specifically bind to LukA'B and not the other five toxins.

LukD Antibody Generation.

A cohort of Balb/c and C3H mice received three intraperitoneal (i.p.) injections of recombinant LukD protein mixed with either Complete (Sigma catalog #F5881) or Incomplete (Sigma catalog #F5506) Freund's adjuvant over the course of 6 weeks. Immune titers were tested at an intermediate time point, and all mice had titers of at least 64,000. Titer is defined as the greatest sera dilution at which anti-LukD antibodies could be detected above background by ELISA. At the end of the 6 week period, animals were injected subcutaneously (s.q.) at the base of the tail (B.O.T.) with LukD protein and an agonistic anti-mouse-CD40 mAb (R&D Systems catalog #MAB440) diluted in DPBS. Four days after the B.O.T injection, spleens were harvested, homogenized, and a B cell enriched fraction was isolated by Magnetic Activated Cell Sorting (MACS). B cells and FO mouse myeloma cells were co-incubated in a polyethylene glycol (PEG)-4000 solution to generate mAb secreting hybridomas cell lines. Following 10 days of hybridoma growth, hybridoma conditioned media was added to assay plates coated with LukD protein, and ELISA was performed to identify hybridomas that produce LukD binding mAbs. Hybridoma media samples positive for binding to LukD were subsequently screened by ELISA to identify samples specific to LukD, which exhibited no detectable binding to LukA'B, LukS-PV, LukE, HlgA, or HlgC.

The immunoglobulin heavy chain (HC) and (LC) genes were cloned from the hybridoma cells by RT-PCR, followed by cDNA synthesis. For HC and LC RT-PCR, pools of primers complementary to v-region framework 1 (FR1) and single primers complementary to a region of constant domain 1 (CD1) were used. Double stranded HC and LC cDNA fragments were ligated into plasmids to enable sequencing and expression of full length murine LC and HC (IgG1 isotype). LC and HC plasmids were transformed into competent E. coli, multiple colonies per chain were picked, and the LC and HC genes were sequenced. Plasmid DNA for the consensus sequence for each chain was prepared for mAb protein expression.

Expi293F cells were co-transfected with cognate LC and HC expressing plasmid pairs using Gibco's Expifectamine transfection fit. Culture supernatants were harvested 5 days later, and the mAb concentrations were determined. The recombinantly expressed mAbs were re-tested by ELISA for binding to LukD to validate binding.

LukE Antibody Generation.

A cohort of Balb/c and C3H mice received three intraperitoneal (i.p.) injections of recombinant LukE protein mixed with either Complete (Sigma catalog #F5881) or Incomplete (Sigma catalog #F5506) Freund's adjuvant over the course of 8 weeks. Immune titers were tested at an intermediate time point, and all mice had titers of at least 72,000. Titer is defined as the greatest sera dilution at which anti-LukE antibodies could be detected above background by ELISA. At the end of the 8 week period, animals were injected subcutaneously (s.q.) at the base of the tail (B.O.T.) with LukE protein and an agonistic anti-mouse-CD40 mAb (R&D Systems catalog #MAB440) diluted in DPBS.

Four days after the B.O.T injection, spleens were harvested, homogenized, and a B cell enriched fraction was isolated by Magnetic Activated Cell Sorting (MACS). B cells and FO mouse myeloma cells were co-incubated in a polyethylene glycol (PEG)-4000 solution to generate mAb secreting hybridomas cell lines. Following 10 days of hybridoma growth, hybridoma conditioned media was added to assay plates coated with LukE protein, and ELISA was performed to identify hybridomas that produce LukE binding mAbs. Hybridoma media samples positive for binding to LukE were subsequently screened by ELISA to identify samples specific to LukE, which exhibited no detectable binding to LukA'B, LukD, LukS-PV, HlgA, or HlgC.

The immunoglobulin heavy chain (HC) and (LC) genes were cloned from the hybridoma cells by RT-PCR, followed by cDNA synthesis. For HC and LC RT-PCR, pools of primers complementary to v-region framework 1 (FR1) and single primers complementary to a region of constant domain 1 (CD1) were used. Double stranded HC and LC cDNA fragments were ligated into plasmids to enable sequencing and expression of full length murine LC and HC (IgG1 isotype). LC and HC plasmids were transformed into competent *E. coli*, multiple colonies per chain were picked, and the LC and HC genes were sequenced. Plasmid DNA for the consensus sequence for each chain was prepared for mAb protein expression.

Expi293F cells were co-transfected with cognate LC and HC expressing plasmid pairs using Gibco's Expifectamine transfection fit. Culture supernatants were harvested 5 days later, and the mAb concentrations were determined. The recombinantly expressed mAbs were re-tested by ELISA for binding to all five of the aforementioned leukotoxins or subunits thereof to validate mAbs that specifically bind to LukE and not the other five toxins.

HlgA Antibody Generation.

A cohort of Balb/c and C3H mice received three intraperitoneal (i.p.) injections of recombinant HlgA protein mixed with either Complete (Sigma catalog #F5881) or Incomplete (Sigma catalog #F5506) Freund's adjuvant over the course of 8 weeks. Immune titers were tested at an intermediate time point, and all mice had titers of at least 72,000. Titer is defined as the greatest sera dilution at which anti-HgA antibodies could be detected above background by ELISA. At the end of the 8 week period, animals were injected subcutaneously (s.q.) at the base of the tail (B.O.T.) with HlgA protein and an agonistic anti-mouse-CD40 mAb (R&D Systems catalog #MAB440) diluted in DPBS.

Four days after the B.O.T injection, spleens were harvested, homogenized, and a B cell enriched fraction was isolated by Magnetic Activated Cell Sorting (MACS). B cells and FO mouse myeloma cells were co-incubated in a polyethylene glycol (PEG)-4000 solution to generate mAb secreting hybridomas cell lines. Following 10 days of hybridoma growth, hybridoma conditioned media was added to assay plates coated with HlgA protein, and ELISA was performed to identify hybridomas that produce HlgA binding mAbs. Hybridoma media samples positive for binding to HgA were subsequently screened by ELISA to identify samples specific to HlgA, which exhibited no detectable binding to LukA'B, LukD, LukS-PV, LukE or HlgC.

The immunoglobulin heavy chain (HC) and (LC) genes were cloned from the hybridoma cells by RT-PCR, followed by cDNA synthesis. For HC and LC RT-PCR, pools of primers complementary to v-region framework 1 (FR1) and single primers complementary to a region of constant domain 1 (CD1) were used. Double stranded HC and LC cDNA fragments were ligated into plasmids to enable sequencing and expression of full length murine LC and HC (IgG1 isotype). LC and HC plasmids were transformed into competent *E. coli*, multiple colonies per chain were picked, and the LC and HC genes were sequenced. Plasmid DNA for the consensus sequence for each chain was prepared for mAb protein expression.

Expi293F cells were co-transfected with cognate LC and HC expressing plasmid pairs using Gibco's Expifectamine transfection fit. Culture supernatants were harvested 5 days later, and the mAb concentrations were determined. The recombinantly expressed mAbs were re-tested by ELISA for binding to all six of the aforementioned leukotoxins or subunits thereof to validate mAbs that specifically bind to HlgA and not the other five toxins.

HlgC Antibody Generation. A cohort of Balb/c and C3H mice received five intraperitoneal (i.p.) injections of recombinant HlgC protein mixed with either Complete (Sigma catalog #F5881) or Incomplete (Sigma catalog #F5506) Freund's adjuvant over the course of 3 months. Immune titers were tested at an intermediate time point, and all mice had titers between 72,000 to 218,000. Titer is defined as the greatest sera dilution at which anti-HlgC antibodies could be detected above background by ELISA. At the end of the 3 month period, animals were injected subcutaneously (s.q.) at the base of the tail (B.O.T.) with HlgC protein and an agonistic anti-mouse-CD40 mAb (R&D Systems catalog #MAB440) diluted in DPBS.

Four days after the B.O.T injection, spleens were harvested, homogenized, and a B cell enriched fraction was isolated by Magnetic Activated Cell Sorting (MACS). B cells and FO mouse myeloma cells were co-incubated in a polyethylene glycol (PEG)-4000 solution to generate mAb secreting hybridomas cell lines. Following 10 days of hybridoma growth, hybridoma conditioned media was added to assay plates coated with HlgC protein, and ELISA was performed to identify hybridomas that produce HlgC binding mAbs. Hybridoma media samples positive for binding to HlgC were subsequently screened by ELISA to identify samples specific to HlgC, which exhibited no detectable binding to LukA'B, LukD, LukS-PV, LukE, or HlgA.

The immunoglobulin heavy chain (HC) and (LC) genes were cloned from the hybridoma cells by RT-PCR, followed by cDNA synthesis. For HC and LC RT-PCR, pools of primers complementary to v-region framework 1 (FR1) and single primers complementary to a region of constant domain 1 (CD1) were used. From this point, HC and LC expression plasmids were made by one of two methods. In the first method, double stranded HC and LC cDNA fragments were ligated into plasmids to enable sequencing and expression of full length murine LC and HC (IgG1 isotype). LC and HC plasmids were transformed into competent *E. coli*, multiple colonies per chain were picked, and the LC and HC genes were sequenced. Plasmid DNA for the consensus sequence for each chain was prepared for mAb protein expression. In the second method, cDNA fragments were sequenced by Next Generation Sequencing. Following sequencing, a panel of mAb HC and LC sequences were selected for de novo gene synthesis based upon quality of the sequencing data, sequence redundancy, and predicted mAb expression risks (i.e. mAb sequences with known post-translational liabilities were excluded). De novo gene synthesis was performed to generate plasmid DNA for mAb protein expression.

Expi293F cells were co-transfected with cognate LC and HC expressing plasmid pairs using Gibco's Expifectamine transfection fit. Culture supernatants were harvested 5 days later, and the mAb concentrations were determined. The recombinantly expressed mAbs were re-tested by ELISA for binding to all six of the aforementioned leukotoxins or subunits thereof to validate mAbs that specifically bind to HlgC and not the other five toxins.

LukE/HigA Antibody Generation.

A cohort of Balb/c and C3H mice received three intraperitoneal (i.p.) injections of recombinant LukE plus HlgA protein mixed with either Complete (Sigma catalog #F5881) or Incomplete (Sigma catalog #F5506) Freund's adjuvant over the course of 6 weeks. Immune titers to both LukE and HlgA were tested at an intermediate time point. All C3H mice had titers to both antigens of at least 128,000. Four out of five Balb/c mice exhibited titers, ranging from 4000-64,000 to HlgA and 8000-64,000 to LukE. Titer is defined as the greatest sera dilution at which anti-HgA and anti-LukE antibodies could be detected above background by ELISA. At the end of the 6 week period, animals were injected subcutaneously (s.q.) at the base of the tail (B.O.T.) with LukE plus HlgA proteins and an agonistic anti-mouse-CD40 mAb (R&D Systems catalog #MAB440) diluted in DPBS.

Four days after the B.O.T injection, spleens were harvested, homogenized, and a B cell enriched fraction was isolated by Magnetic Activated Cell Sorting (MACS). B cells and FO mouse myeloma cells were co-incubated in a polyethylene glycol (PEG)-4000 solution to generate mAb secreting hybridomas cell lines. Following 10 days of hybridoma growth, hybridoma conditioned media was added to assay plates coated with a combination of LukE and HlgA protein, and ELISA was performed to identify hybridomas that produce LukE and/or HgA binding mAbs. Hybridoma media samples positive for binding to LukE and/or HgA were subsequently screened by ELISA to identify samples specific to LukE and/or HlgA, which exhibited no detectable binding to LukA'B, LukD, LukS-PV or HlgC.

The immunoglobulin heavy chain (HC) and (LC) genes were cloned from the hybridoma cells by RT-PCR, followed by cDNA synthesis. For HC and LC RT-PCR, pools of primers complementary to v-region framework 1 (FR1) and single primers complementary to a region of constant domain 1 (CD1) were used. cDNA fragments were sequenced by Next Generation Sequencing. Following sequencing, a panel of mAb HC and LC sequences were selected for de novo gene synthesis based upon quality of the sequencing data, sequence redundancy, and predicted mAb expression risks (i.e. mAb sequences with known post-translational liabilities were excluded). De novo gene synthesis was performed to generate plasmid DNA for mAb protein expression.

Expi293F cells were co-transfected with cognate LC and HC expressing plasmid pairs using Gibco's Expifectamine transfection fit. Culture supernatants were harvested 5 days later, and the mAb concentrations were determined. The recombinantly expressed mAbs were re-tested by ELISA for binding to all six of the aforementioned leukotoxins or subunits thereof to validate mAbs that specifically bind to LukE and/or HlgA and not the other toxins.

Example 2—Characterization of Monoclonal Antibodies that Bind Leukotoxin Subunit LukD Via Non-Competing Epitopes and Exhibit Differential LukED Neutralization Activity A series of monoclonal antibodies (mAbs) were identified from hybridoma cell lines derived from the spleens of mice following immunization with recombinant LukD protein as described in Example 1. Herein is described the characterization of the interaction of two such anti-LukD mAbs, antibody SM1B221 (SEQ ID NOs: 422 HC plus SEQ ID NO: 414 LC) and antibody SM1B225 (SEQ ID NOs: 426 HC plus SEQ ID NO: 418 LC), with the LukD protein. These experiments demonstrate that the LukD antigen is able to engage with both mAbs simultaneously indicating that they bind different epitopes. Further, while SM1B225 neutralizes the cytolytic activity of the LukED leukotoxin against human polymorphonuclear leukocytes (PMNs), SM1B221 exhibits no detectable neutralization activity. These data substantiate the notion that mAbs can be identified that bind leukotoxin subunits through alternate epitopes, and that only a subset of these correspond to neutralizing epitopes wherein mAb binding inhibits the cytolytic activity of the targeted leukotoxin.

Procedures. Proteins.

mAbs SM1B221 and SM1B225 were purified from transiently transfected Expi293F cells (ThermoFisher Scientific Inc.) and purified by standard chromatographic methods with Protein G SEPHAROSE (GE Healthcare Life Sciences Inc.) as the primary capture resin. A recombinant derivative of the LukD protein (SEQ ID NO: 824) that bears an amino-terminal polyhistidine affinity tag and was purified from *E. coli* by Nickel affinity chromatography. For LukED neutralization assays, recombinant LukD and LukE subunits bearing polyhistidine affinity tags (SEQ ID NOs: 826 (LukE) and 825 (LukD)) were individually purified from *S. aureus* and combined at the time of the assay (as indicated below).

ELISA Assays.

Binding of the mAbs to purified, recombinant LukD protein that was chemically biotinylated in vitro was determined by ELISA. Briefly, 100 µl of a 5 µg/mL solution of streptavidin (in PBS) was added per well of a 96 well White Maxisorp plate (Nunc-cat #436110) and incubated overnight at 4° C. Wells were then washed 3× with TBST (50 mM Tris HCl, pH 7.4, 150 mM NaCl, 0.1% TWEEN 20), blocked with 300 µL/well StartingBlock T20 (Pierce cat #37543), and incubated 45-60 minutes at room temperature (RT). The plate was washed 3 times with TBST and 0.2 µg of a biotinylated preparation of LukD protein (in 100 µl) was added to each test well. The plate was incubated 45-60 minutes at RT with gentle shaking. The plate was then washed 3 times with TBST. In separate dilution plates, the mAb test articles were serially diluted four-fold in blocking buffer starting at 10 µg/mL. Titrated test articles (100 µl) were added to test wells and the plate incubated 45-60 minutes at RT with gentle shaking. The plate was then washed 3 times with TBST. For detection of bound test articles, 100 µl L/well of a peroxidase-conjugated, F(ab')2 fragment of a goat anti-mouse IgG, FC-γ fragment specific antibody (Jackson Immuno Research product 115-036-071) diluted 1:5000 in Starting block T20 was added and the plate incubated for 45-60 min at RT with gentle shaking. The plate was then washed 3 times with TBST. To detect bound F(ab')2 fragment of the goat anti-mouse antibody, 100 µl/well of the POD Chemiluminescence substrate (Roche-cat #11582950001) was added immediately prior to reading plates and the plates read using an Envision reader within 15 minutes of the substrate addition. The data were analyzed using GraphPad Prism. Values were transformed to a log scale and fit using a non-linear regression sigmoidal dose-response equation resulting in an eleven point binding curve for each antibody against each antigen.

LukED Neutralization Studies.

For LukED neutralization studies, the anti-LukD mAb test articles (0.625 µg/mL) in 100 µL reactions were incubated with purified, recombinant LukED (2.5 µg/mL per subunit; 72.5 nM) for 30 mins at 4° C. Freshly isolated human primary polymorphonuclear leukocytes (hPMNs, 200,000 cells in RPMI+10 mM HEPES+0.1% HSA) were added to the mixture of LukED and mAb protein to a final volume of 100 µl. Ethidium bromide was then added to the cells at 1:2000 final dilution and plates were read 30 and 60 mins post toxin addition. Following 1 hour intoxication in a 37° C. $CO_2$ incubator, 25 µl of supernatant was carefully transferred to a new plate after spinning the plate down at 1500 RPM for 10 mins. Cell Titer reagent (Promega) was added to the remaining cells and incubated for 1.5 hours. The 25 µl of supernatant were mixed with equal amounts of CytoTox-ONE™ Assay reagent (Promega) that rapidly measures the release of lactate dehydrogenase (LDH) from cells with a damaged membrane. LDH released into the culture medium was measured with a 10-minute coupled enzymatic assay that results in the conversion of resazurin into a fluorescent resorufin product. For the neutralization experiments, LukED was used at a concentration of 72.5 nM (2.5p g/mL per subunit).

Determination of Affinity ($K_D$) Constants.

$K_D$ values for LukD were determined by Bio-Layer Interferometry (BLI) using an Octet$^{RED}$ 384 instrument (forteBIO Inc.) running the basic kinetics protocol ("Biomolecular Binding Kinetics Assays on the Octet Platform", as outlined in *Application Note* 14 from Pall forteBIO Corp. accessible via the FortBIO website). Briefly, biotinylated LukD protein was loaded onto Dip and Read™ Streptavidin (SA) Biosensor pins at a 10 μg/mL concentration in PBS pH7.2 for 5 minutes. A baseline was set by washing with phosphate buffered saline (PBS, pH 7.2) for 1 minute. The association rates for mAbs SM1B221 and SM1B225 were measured by addition of a 10 μg/mL concentration in PBS (pH7.2) over a period of 5 minutes. Following initial binding of either the SM1B221 or the SM1B225 mAb, a baseline was reset by washing with phosphate buffered saline (PBS, pH 7.2) for 1 minute. Binding of the second mAb was measured by addition of a 10 ug/mL concentration in PBS (pH7.2) over a period of 5 minutes. Curve fitting to determine $K_D$ values used the initial 120 seconds of association and 60 seconds of dissociation to analyze on and off rates.

Results.

The binding of the anti-LukD mAbs SM1B221 and SM1B225 to purified LukD protein as determined by an ELISA assay is shown in FIG. 1A. For each, saturation binding is apparent at a concentration of 1 μg/mL under these conditions with half maximal binding in the 0.01 to 0.2 μg/mL range with slightly higher affinity apparent for the SM1B221 mAb.

Figure 1B:
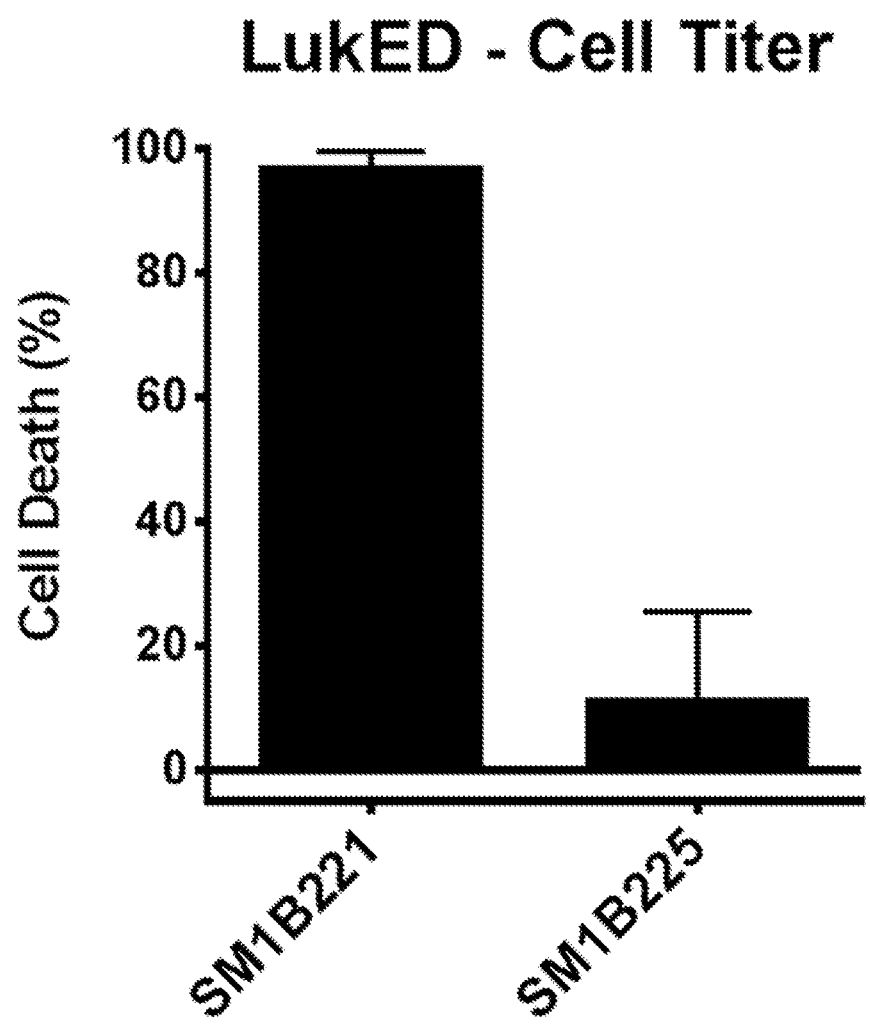
Figure 1C:
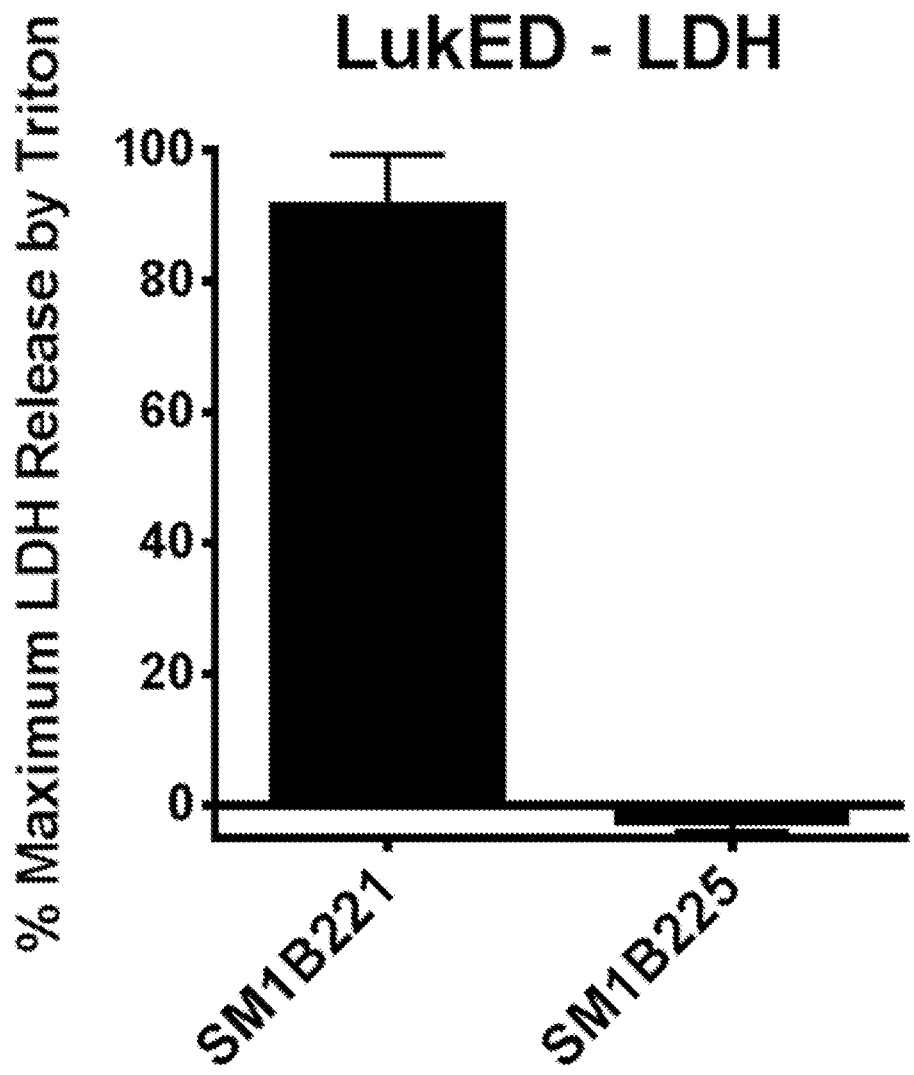

The ability of the anti-LukD mAbs SM1B221 and SM1B225 to inhibit cytolytic activity of LukED against hPMNs was determined by measuring (i) LDH release from lysed cells using the CytoTox-ONE™ assay reagent (Promega), and (ii) by quantitation of ATP present—an indicator of metabolically active cells—using the Cell Titer reagent (Promega). As is shown in FIGS. 1B-C, SM1B221 does not inhibit LukED mediated cytolysis of hPMNs as determined either by LDH release (FIG. 1C) or ATP levels (FIG. 1). In contrast, minimal if any cytolysis of hPMNs is apparent with SM1B225. These data clearly indicate that the anti-LukD mAbs SM1B221 and SM1B225 have differential activity in neutralizing the cytolytic activity of the LukED leukotoxin and imply that they interact with the LukD protein through distinct binding epitopes.

Figure 1D:
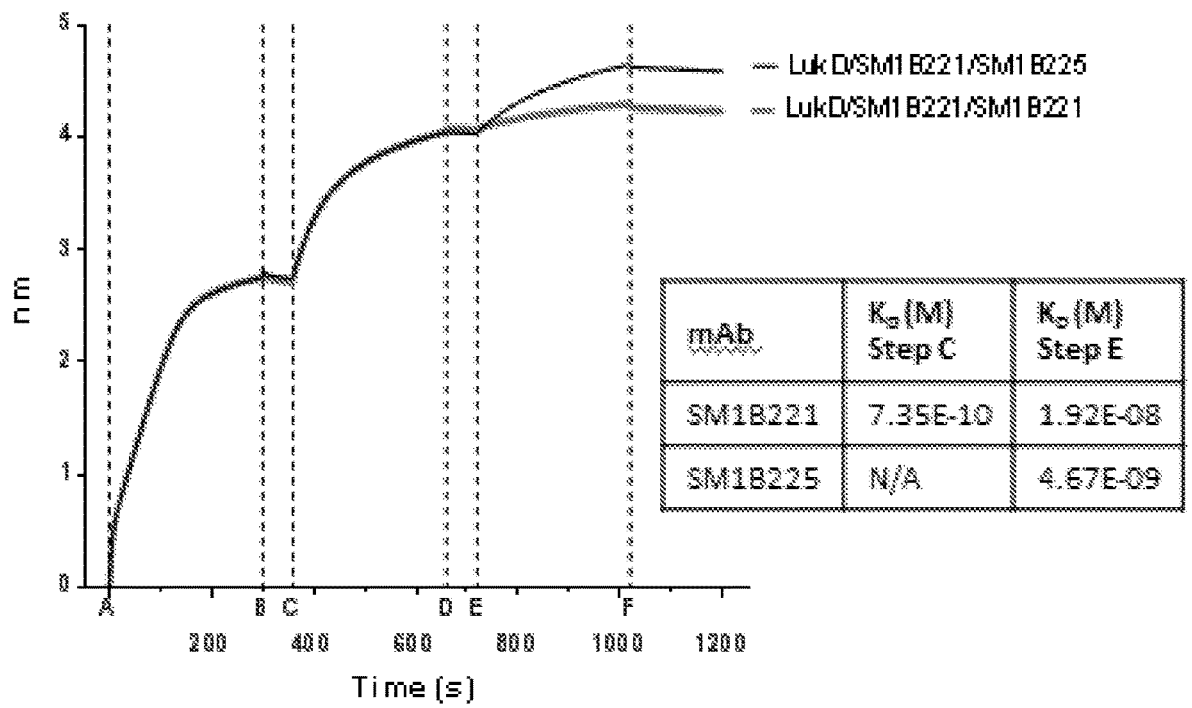

If the anti-LukD mAbs SM1B221 and SM1B225 bind LukD through distinct binding sites, then it would be expected that they would not exhibit competition in binding and this was assessed by Bio-Layer Interferometry (BLI). FIG. 1D shows the BLI trace for an experiment wherein a biotinylated variant of LukD was first loaded to apparent saturation onto a streptavidin-coated biosensor pin followed by near saturation binding of the SM1B221 mAb. After a PBS wash, either SM1B221 or SM1B225 was then added and binding measured for a further five minutes. As expected, minimal additional binding of SMB221 was detected. However, addition of SM1B225 resulted in a further increase in the BLI signal indicating that the LukD protein immobilized on the pin displays the SM1B225 binding epitope in the presence of saturation binding of the SM1B221 mAb.

Figure 1E:
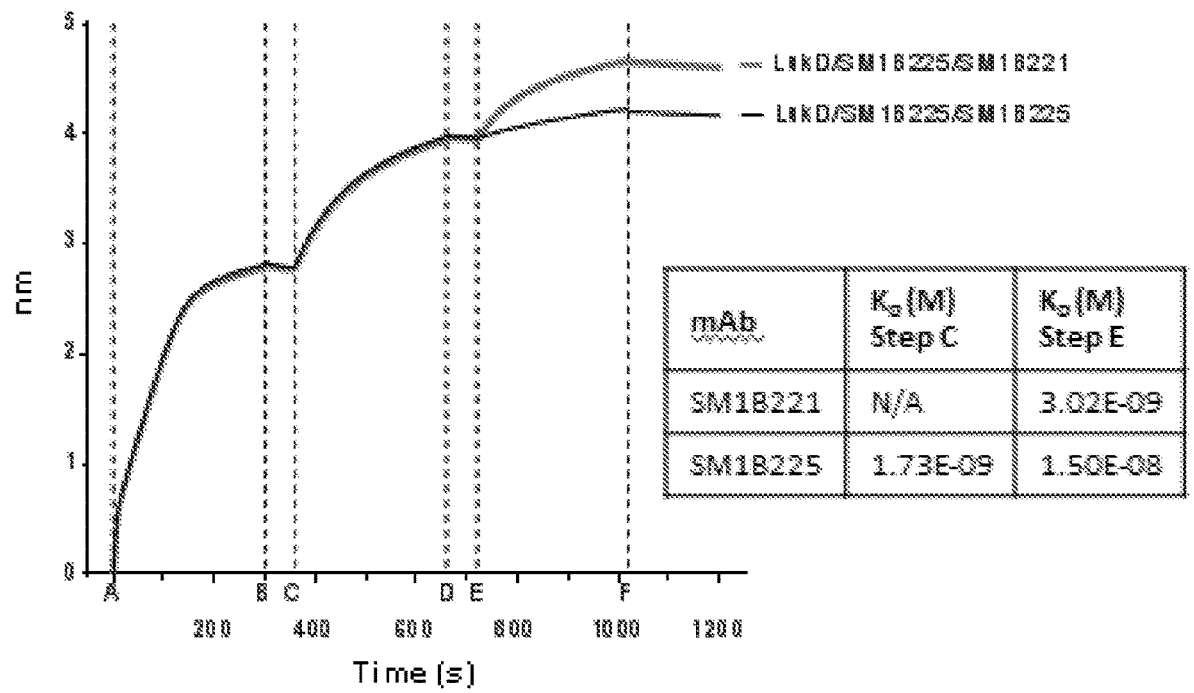

FIG. 1E shows the BLI trace for an experiment wherein a biotinylated variant of LukD was first loaded to apparent saturation onto a streptavidin-coated biosensor pin followed by near saturation binding of the SM1B225 mAb. After a PBS wash, either SM1B221 or SM1B225 was then added and binding measured for a further five minutes. As expected, minimal additional binding of SM1B225 was detected. However, addition of SM1B221 resulted in a further increase in the BLI signal indicating that the LukD protein immobilized on the pin displays the SM1B221 binding epitope in the presence of saturation binding of the SMB221 mAb. These BLI data clearly indicate that the anti-LukD mAbs SM1B221 and SM1B225 bind LukD through distinct and non-competing binding sites.

Summary.

Analysis of the LukED neutralization activity of the anti-LukD mAbs SM1B221 and SM1B225 clearly indicates that only the SM1B225 mAb exhibits activity in blocking LukED mediated cytolysis of hPMNs (FIGS. 1B-C) despite both antibodies exhibiting potent LukD binding activity (FIG. 1A). The notion that they bind LukD via different binding epitopes is further substantiated by data from BLI studies indicating that SM1B221 and SM1B225 do not compete with each other in binding LukD.

Example 3—Characterization of Monoclonal Antibodies that Bind the LukAB Leukotoxin Via Non-Competing Epitopes and Exhibit Differential Effects on LukAB Activity A series of monoclonal antibodies (mAbs) were identified from hybridoma cell lines derived from the spleens of mice following immunization with recombinant LukAB protein (see Example 1). Herein is described the characterization of the interaction of four such anti-LukAB mAbs (SM1B111-SEQ ID NO: 265 HC plus SEQ ID NO: 224 LC; SM1B245-SEQ ID NO: 269 HC plus SEQ ID NO: 228 LC; SM1B249-SEQ ID NO: 273 HC plus SEQ ID NO: 237 LC; and SM1B252-SEQ ID NO: 276 HC plus SEQ ID NO: 235 LC) with the LukAB protein. As demonstrated herein these four LukAB mAbs exhibit both differences in binding characteristics and apparent differences in their impact on LukAB activities. These data further substantiate the notion that mAbs can be identified that bind leukotoxins (or subunits thereof) via alternate epitopes and that such differential binding impacts leukotoxin activity in distinct ways.

Procedures. Proteins.

mAbs SM1B111, SM1B245, SM1B249 and SM1B252 were purified from transiently transfected Expi293F cells (ThermoFisher Scientific Inc.) and purified by standard chromatographic methods with Protein G SEPHAROSE (GE Healthcare Life Sciences Inc.) as the primary capture resin. For LukAB binding studies conducted by ELISA assay or Bio-Layer Interferometry (BLI), a recombinant toxoid variant of the LukAB protein (LukA E323 A) was used (DuMont et al., "Identification of a Crucial Residue Required for *Staphylococcus aureus* LukAB Cytotoxicity and Receptor Recognition,", *Infect Immun.* 82(3): 1268-76 (2014), which is hereby incorporated by reference in its entirety) that further bears poly-histidine and streptavidin binding sequences at the amino-terminus of the LukA sequence (SEQ ID NOs: 827 LukA and 828 LukB). Recombinant LukAB toxoid protein (LukA E323 A) protein was purified by nickel affinity chromatography as soluble heterodimers from an *E. coli* strain expressing biotin ligase. For LukAB neutralization and human CD11 b I-domain interaction studies, a recombinant form of the LukAB protein (SEQ ID Nos: 829 LukA and 830 LukB) that bears an amino-terminal polyhistidine affinity tag on the LukA subunit was purified from *S. aureus* by nickel affinity chromatography. For studies of the impact of anti-LukAB mAbs on LukAB interaction with the human CD11 b protein, a recombinant form of the human CD11 b I-domain (SEQ ID NO: 831) was purified from *E. coli* (Dumont et al., "*Staphylococcus aureus* LukAB Cytotoxin Kills Human Neutrophils by Targeting the CD11 b Subunit of the Integrin Mac-1," PNAS 110: 10794-99 (2013), which is hereby incorporated by reference in its entirety).

LukAB Binding Assays by ELISA.

Binding of the anti-LukAB mAbs to purified, recombinant LukAB protein was determined by ELISA. Briefly, 100 µl of a 5 µg/mL solution of streptavidin (in PBS) was added per well of a 96 well White Maxisorp plate (Nunc-cat #436110) and incubated overnight at 4° C. Wells were washed 3× with TBST (50 mM Tris HCl, pH 7.4, 150 mM NaCl, 0.1% TWEEN 20), blocked with 300 µL/well StartingBlock T20 (Pierce cat #37543), and incubated 45-60 minutes at room temperature (RT). The plate was washed 3 times with TBST, and 0.2 µg of a biotinylated preparation of LukAB protein (in 100 µL) was added to each test well. The plate was incubated 45-60 minutes at RT with gentle shaking and then washed 3 times with TBST. In separate dilution plates, the mAb test articles were serially diluted four-fold in blocking buffer starting at 10 µg/mL. 100 µL of titrated test articles were added to test wells and the plate incubated 45-60 minutes at RT with gentle shaking. The plate was then washed 3 times with TBST. For detection of bound test articles, 100 µL/well of a peroxidase-conjugated, F(ab')2 fragment of a goat anti-mouse IgG, FC-g fragment specific antibody (Jackson Immuno Research product 115-036-071) diluted 1:5000 in Starting block T20 was added and the plate incubated for 45-60 min at RT with gentle shaking. The plate was then washed 3 times with TBST. To detect bound F(ab')2 fragment of the goat anti-mouse antibody, 100 µL/well of the POD Chemiluminescence substrate (Roche-cat #11582950001) was added immediately prior to reading plates and the plates read using an Envision reader within 15 minutes of the substrate addition. The data were analyzed using GraphPad Prism. Values were transformed to a log scale and fit using a non-linear regression sigmoidal dose-response equation resulting in an eleven point binding curve for each antibody against each antigen.

LukAB Neutralization Studies.

For LukAB neutralization studies, the anti-LukAB mAb test articles in 100 µL reactions were incubated with purified, recombinant LukAB for 30 mins at 4° C., at a mAb/LukAB molar ration of 10:1. Freshly isolated human primary polymorphonuclear leukocytes (hPMNs, 200,000 cells in RPMI+10 mM HEPES+0.1% HSA) were added to the mixture of LukAB and mAb protein to a final volume of 100 µL. Ethidium bromide was then added to the cells at 1:2000 final dilution and plates were read 30 and 60 mins post toxin addition. Following 1 hour intoxication in a 37° C. $CO_2$ incubator, 25 µL of supernatant was carefully transferred to a new plate after spinning the plate down at 1500 RPM for 10 mins. Cell Titer reagent (Promega) was added to the remaining cells and incubated for 1.5 hours. The 25 µL of supernatant were mixed with equal amounts of CytoTox-ONE™ Assay reagent (Promega) that rapidly measures the release of lactate dehydrogenase (LDH) from cells with a damaged membrane. LDH released into the culture medium was measured with a 10-minute coupled enzymatic assay that results in the conversion of resazurin into a fluorescent resorufin product.

Determination of mAb Affinity ($K_D$) Constants and Competition Binding Studies.

$K_D$ values for LukAB were determined by Bio-Layer Interferometry (BLI) using an Octet$^{RED}$ 384 instrument (forteBIO Inc.) running the basic kinetics protocol ("Biomolecular Binding Kinetics Assays on the Octet Platform", at outlined in *Application Note* 14 from Pall ForteBIO Corp. accessible via the ForteBIO website). Briefly, biotinylated LukAB protein was loaded onto Dip and Read™ Streptavidin (SA) Biosensor pins at a 10 µg/mL concentration in PBS pH7.2 for 5 minutes. A baseline was set by washing with phosphate buffered saline (PBS, pH 7.2) for 1 minute. The association rates for the test article mAbs were measured by addition of a 10 ug/mL concentration in PBS (pH7.2) over a period of 5 minutes. Following initial binding of a mAb, a baseline was reset by washing with phosphate buffered saline (PBS, pH 7.2) for 1 minute. Binding of the second mAb was measured by addition of a 10 µg/mL concentration in PBS (pH7.2) over a period of 5 minutes. Curve fitting to determine $K_D$ values used the initial 60 seconds of association and dissociation steps to analyze on and off rates.

Results.

Figure 2A:
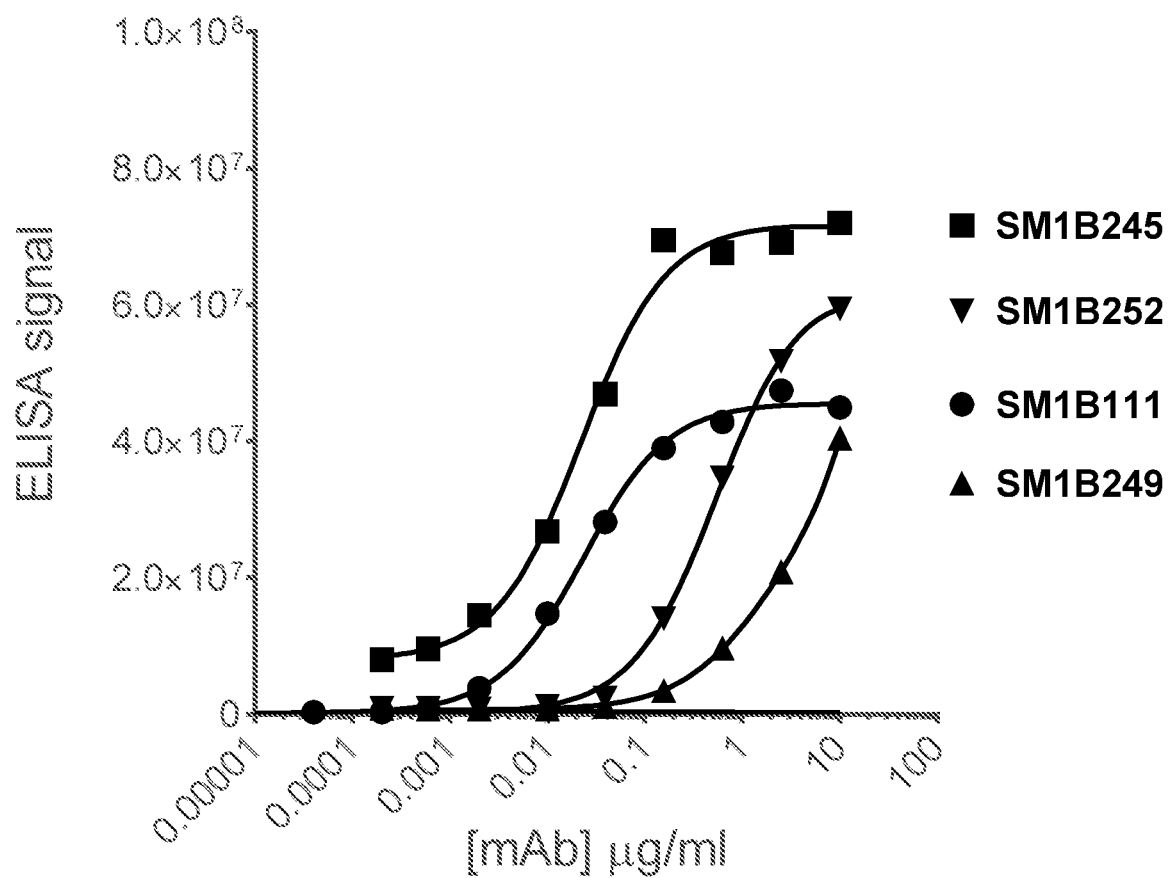

The binding of the anti-LukAB mAbs SM1B111, SM1B245, SM1B249 and SM1B252 to purified LukAB protein as determined by an ELISA assay is shown in FIG. 2A. In this format, apparent saturation binding and half maximal saturation binding is observed over a broad concentration range with the SM1B245 exhibiting the highest apparent binding affinity and SM1B249 exhibiting the weakest apparent binding affinity.

Figure 2B:
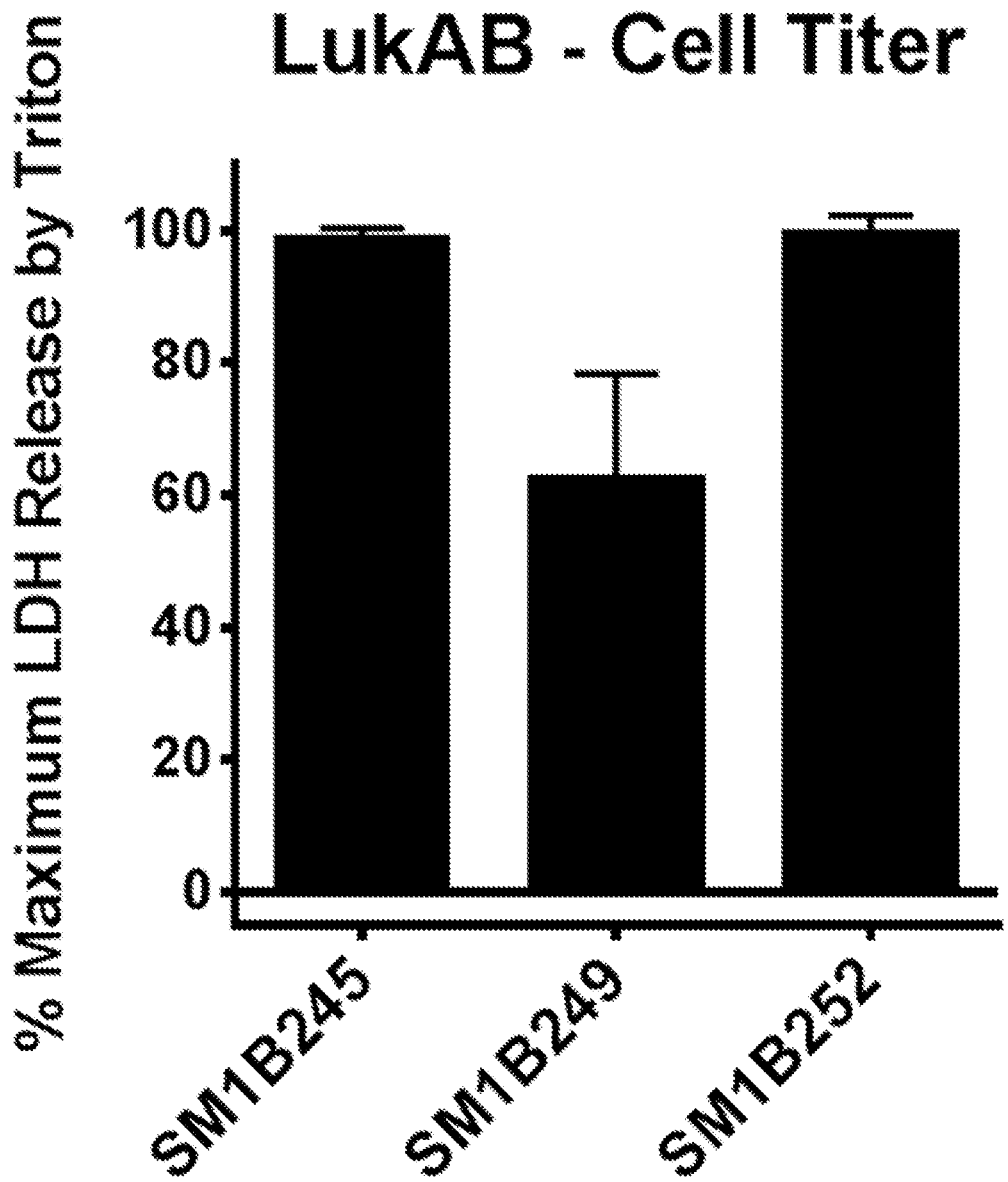
Figure 2C:
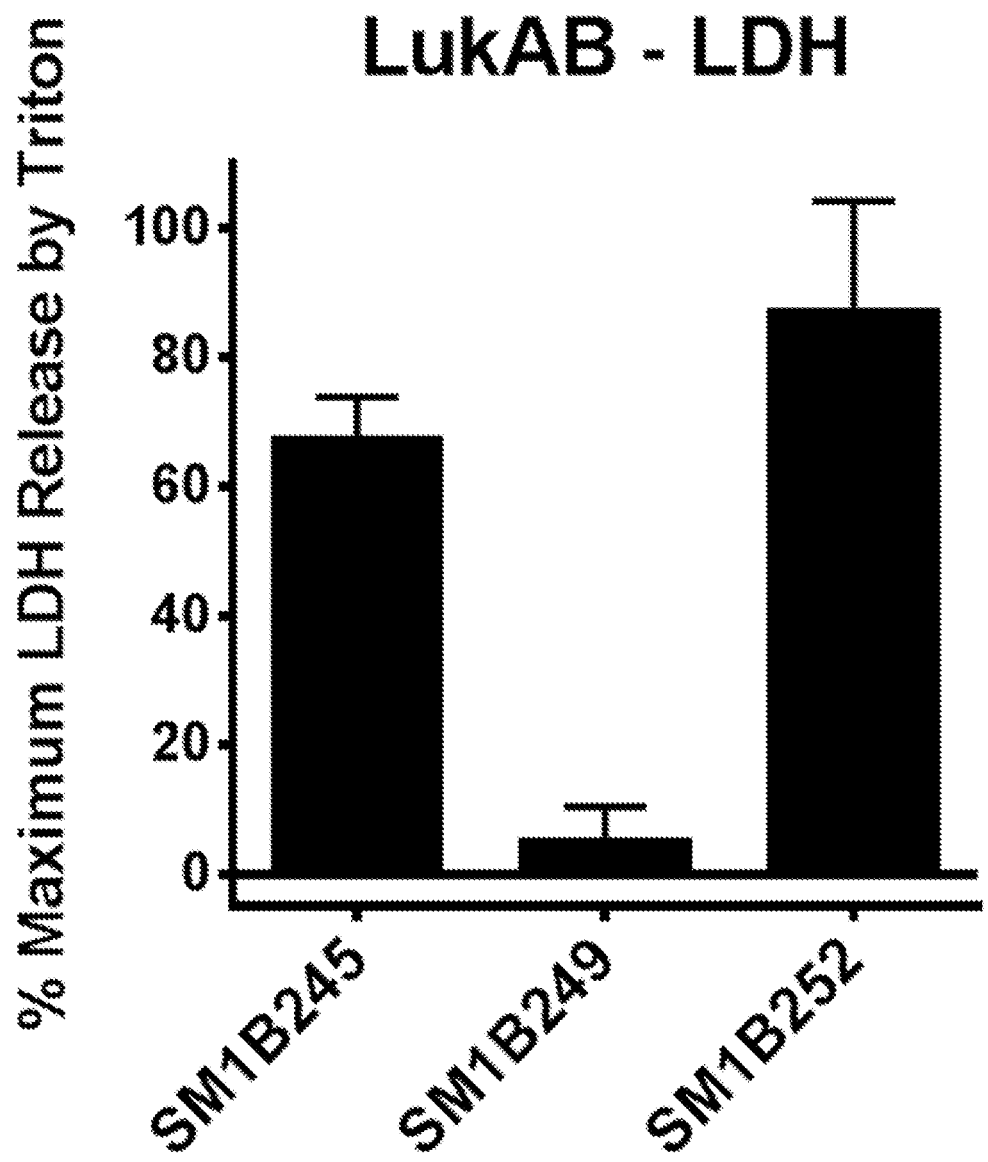

The ability of the anti-LukAB mAbs SM1B245, SM1B249 and SM1B252 to neutralize the cytolytic activity of LukAB against hPMNs was determined by measuring (i) LDH release from lysed cells using the CytoTox-ONE™ assayreagent (Promega), and (ii) by quantitation of ATP present—an indicator of metabolically active cells—using the Cell Titer reagent (Promega). As is shown in FIGS. 2B-C, SM1B249 exhibits the most potent inhibition of cytolysis of hPMNs as determined either by LDH release (FIG. 2C) or ATP levels (FIG. 2B). In contrast, only minimal impact on cytolysis of hPMNs is apparent with SM1B245 and SM1B252. These data clearly indicate that the anti-LukAB mAbs have differential activity in neutralizing the cytolytic activity of the LukAB leukotoxin and imply that they interact with the LukAB protein through distinct binding epitopes.

Figure 2D:
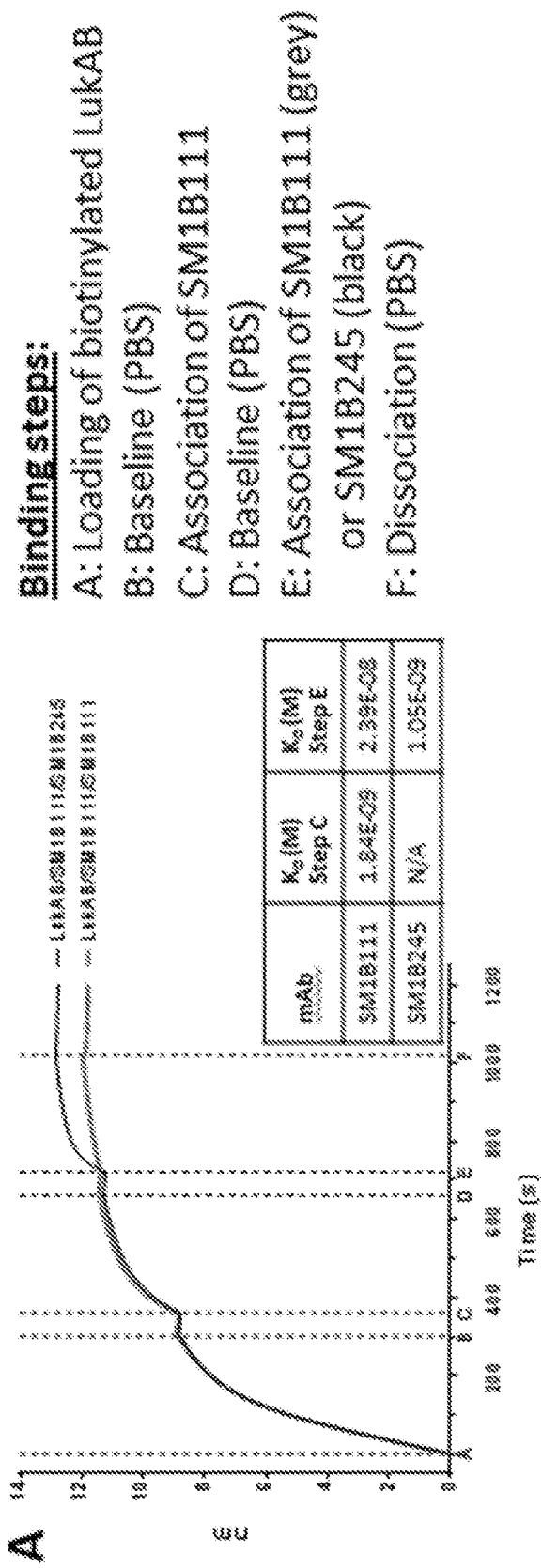
Figure 2E:
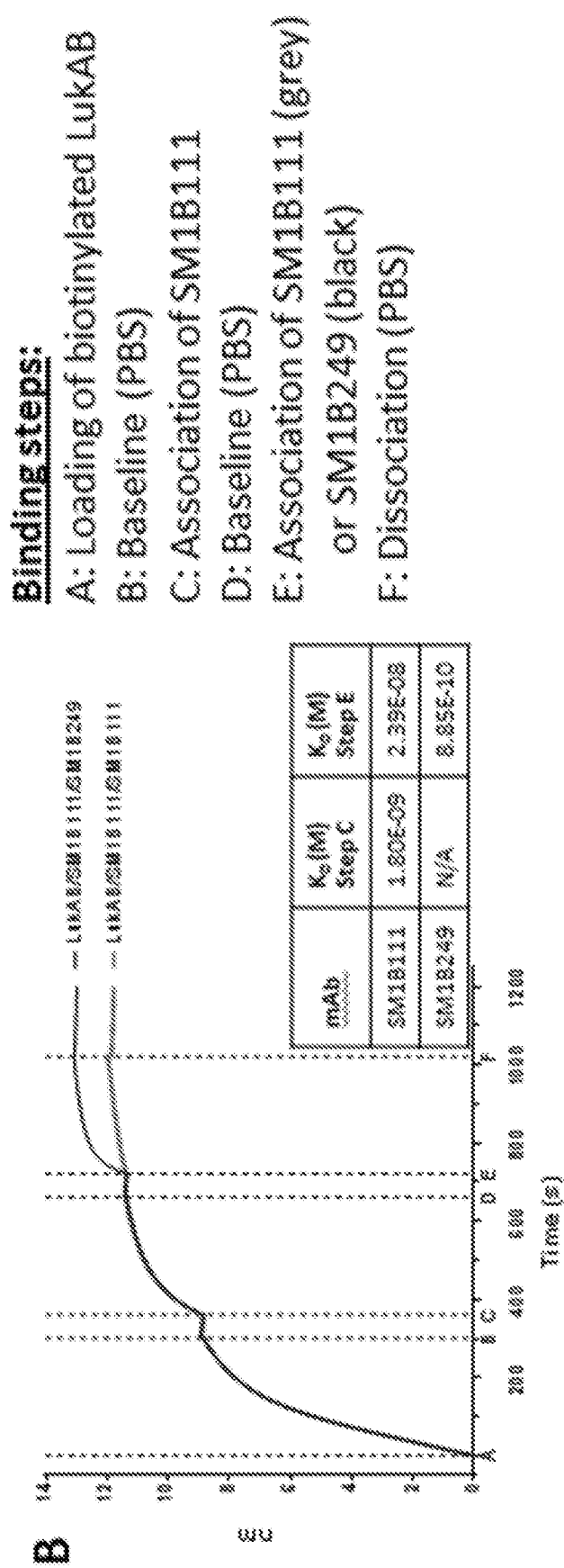

If the anti-LukAB mAbs SM1B245, SM1B249 and SM1B252 bind LukAB through distinct binding sites, then it would be expected that they would not exhibit competition for LukAB binding. Competitive binding studies were carried out using Bio-Layer Interferometry (BLI). FIGS. 2D-E show the BLI trace for an experiment wherein a biotinylated variant of LukAB was first loaded to apparent saturation onto a streptavidin-coated biosensor pin followed by near saturation binding of the SM1B111 mAb. After a PBS wash, either SM1B111, SM1B245, or SM1B249 were then added and binding measured for a further five minutes. As expected, minimal additional binding of SM1B111 was detected (grey, lower line trace). However, addition of either SM1B245 (black, upper line trace in FIG. 2D) or SM1B249 (black, upper line trace in FIG. 2E) resulted in a further increase in the BLI signal indicating that the LukAB protein immobilized on the pin displays the SM1B245 and SM1B249 binding epitopes in the presence of saturation binding of the SM1B111 mAb.

Figure 2F:
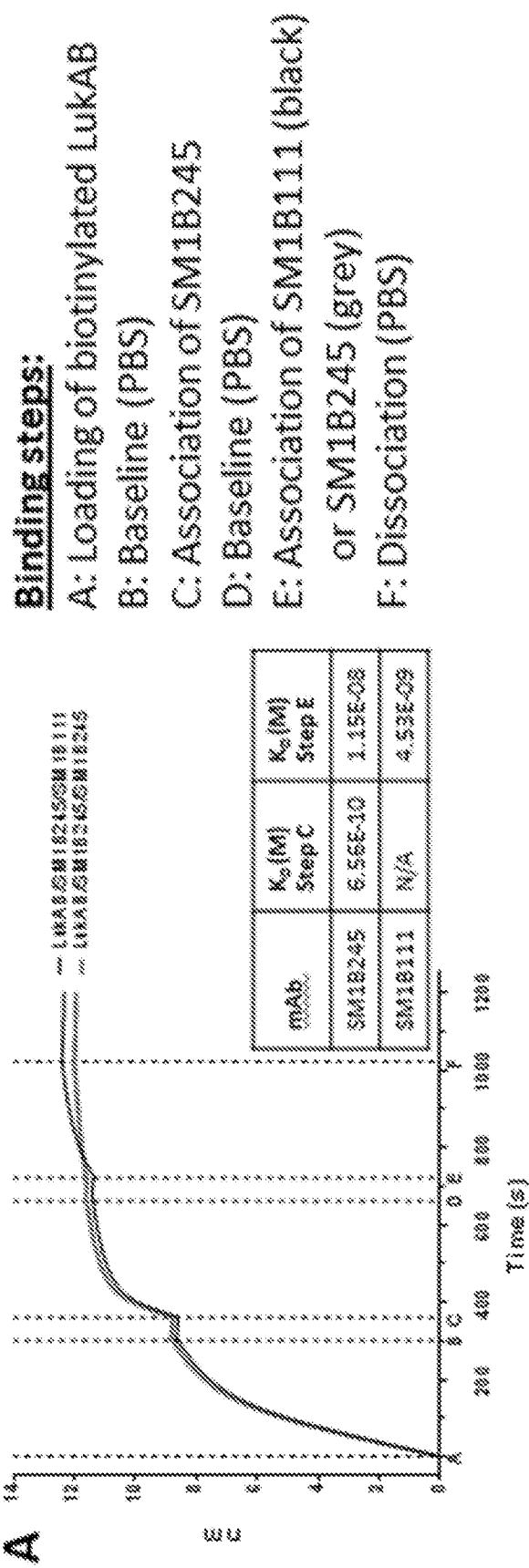
Figure 2G:
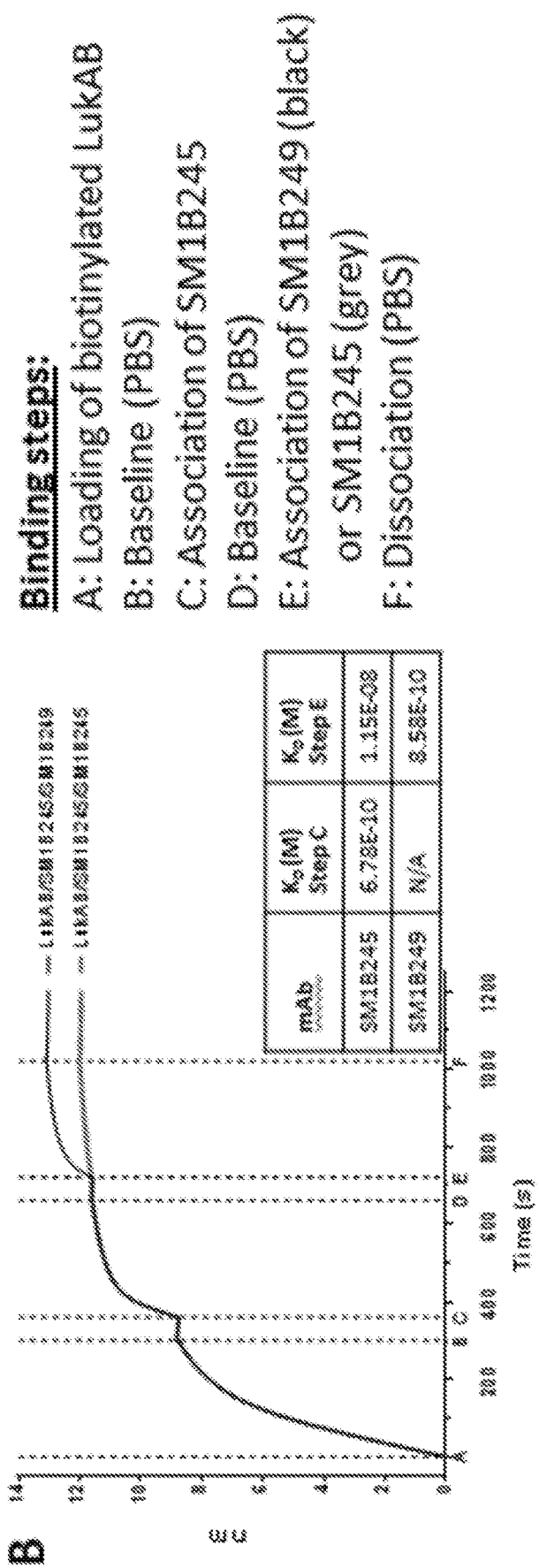

FIGS. 2F-G show the BLI trace for an experiment wherein a biotinylated variant of LukAB was first loaded to apparent saturation onto a streptavidin-coated biosensor pin followed by near saturation binding of the SM1B245 mAb. After a PBS wash, either SM1B245, SM1B111, or SM1B249 were added and binding measured for a further five minutes. As expected, minimal additional binding of SM1B245 was detected (grey, lower line trace). However, addition of either SM1B111 (black, upper line trace in FIG. 2F) or SM1B249 (black, upper line trace in FIG. 2G) resulted in a further increase in the BLI signal indicating that the LukAB protein immobilized on the pin displays the SM1B111 and SM1B249 binding epitopes in the presence of saturation binding of the SM1B245 mAb.

Figure 2H:
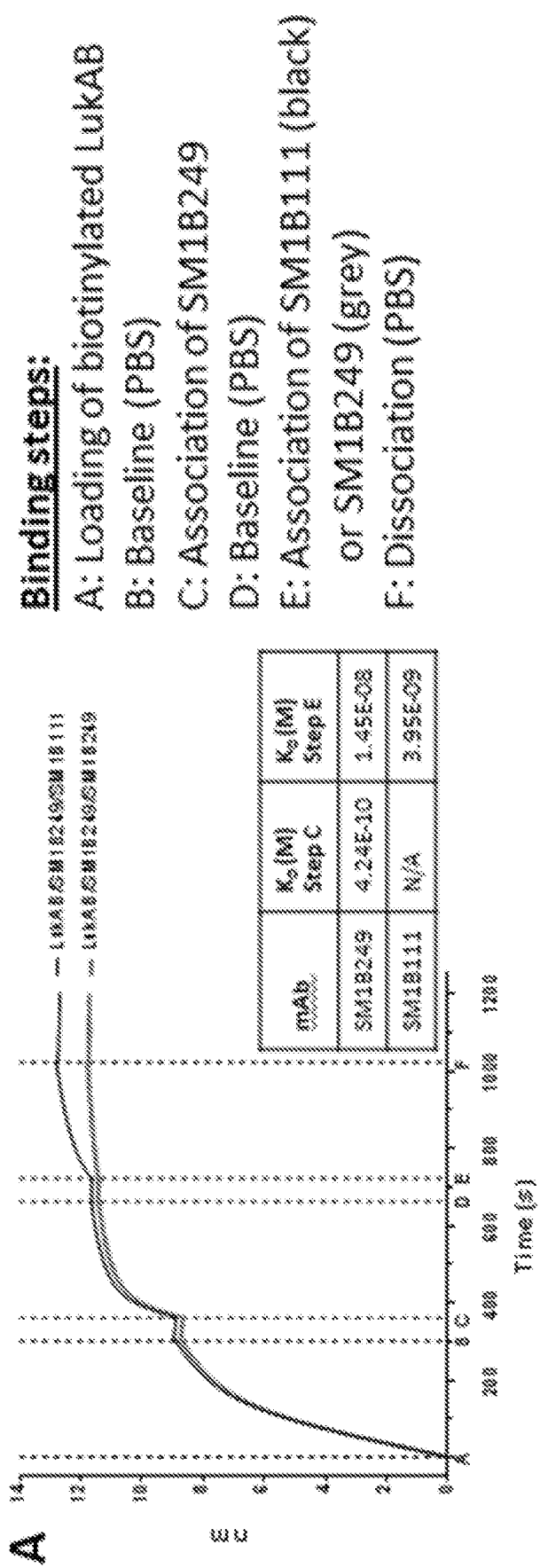
Figure 21:
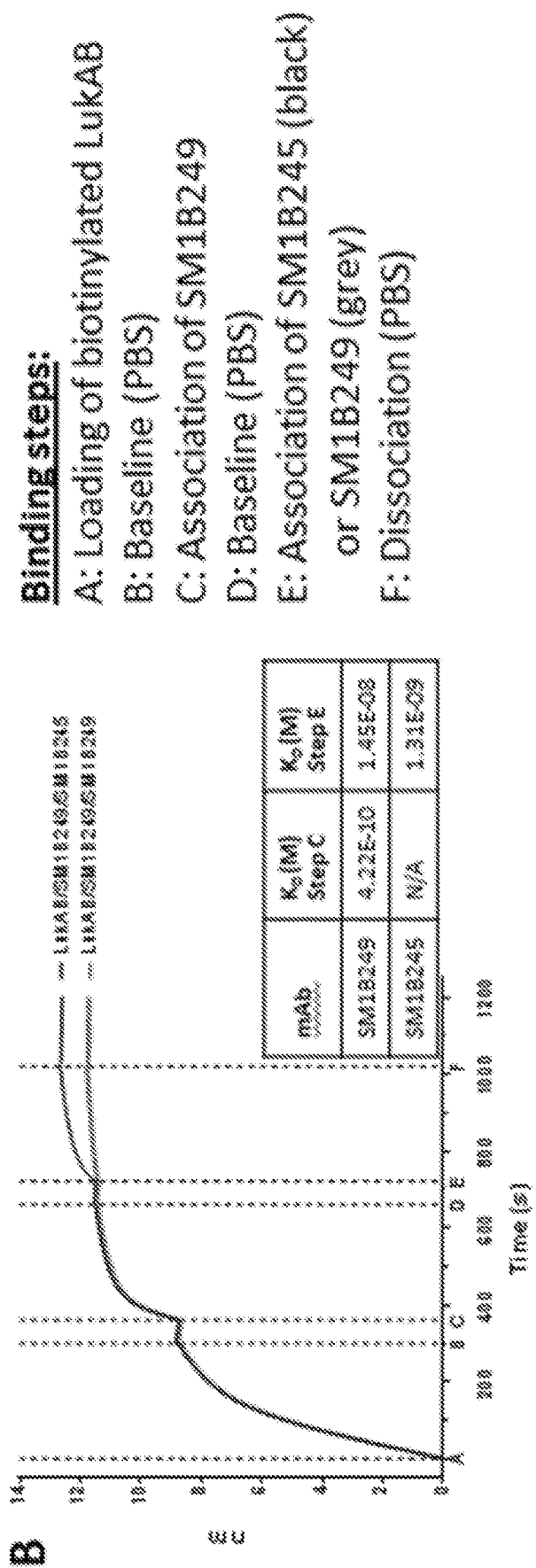

FIGS. 2H-I show the BLI trace for an experiment wherein a biotinylated variant of LukAB was first loaded to apparent saturation onto a streptavidin-coated biosensor pin followed by near saturation binding of the SM1B249 mAb. After a PBS wash, either SM1B249, SM1B111, or SM1B245 were then added and binding measured for a further five minutes. As expected, minimal additional binding of SM1B249 was detected (grey, lower line trace). However, addition of either SM1B111 (black, upper line trace in FIG. 2H) or SM1B245 (black, upper line trace in FIG. 2I) resulted in a further increase in the BLI signal indicating that the LukAB protein immobilized on the pin displays the SM1B111 and SM1B245 binding epitopes in the presence of saturation binding of the SM1B249 mAb.

Summary

Analysis of the LukAB neutralization activity of the anti-LukAB mAbs SM1B111, SM1B245 and SM1B249 indicates that only the SM1B249 mAb exhibits potent activity in blocking LukAB mediated cytolysis of hPMNs (FIGS. 2B-C) despite all three antibodies exhibiting LukAB binding activity (FIG. 2A). The notion that they bind LukAB via different binding epitopes is further substantiated by data from BLI studies indicating that SM1B111, SM1B245, and SM1B249 do not compete with each other in binding LukAB.

Example 4—Characterization of Monoclonal Antibodies that Bind Leukotoxin Subunit LukE Via Non-Competing Epitopes A series of monoclonal antibodies (mAbs) were identified from hybridoma cell lines derived from the spleens of mice following immunization with recombinant LukE protein as described in Example 1. Herein is described the characterization of the interaction of three such anti-LukE mAbs (SM1B318; SEQ ID NOs: 788 HC plus SEQ ID NO: 749 LC, SM1B332; SEQ ID NOs: 802 HC plus SEQ ID NO: 763 LC and SM1B507; SEQ ID NOs: 360 HC plus SEQ ID NO: 348 LC) with the LukE protein and demonstrate that the LukE antigen is able to engage (i) with the SM1B 318 and SM1B332 mAbs simultaneously indicating that they bind different epitopes, and (ii) with the SM1B 332 and SM1B507 mAbs simultaneously indicating that they bind different epitopes.

Procedures. Proteins.

mAbs SM1B318, SM1B332 and SM1B507 were purified from transiently transfected Expi293F cells (ThermoFisher Scientific Inc.) and purified by standard chromatographic methods with Protein A SEPHAROSE (GE Healthcare Life Sciences Inc.) as the primary capture resin. A recombinant derivative of the LukE protein (SEQ ID NO: 826) that bears an amino-terminal poly-histidine affinity tag and was purified from *E. coli* by Nickel affinity chromatography.

ELISA Assays.

Binding of select mAbs to purified, recombinant LukE protein that was chemically biotinylated in vitro was determined by ELISA. Briefly, 100 µl of a 5 µg/mL solution of streptavidin (in PBS) was added per well of a 96 well White Maxisorp plate (Nunc-cat #436110) and incubated overnight at 4° C. Wells were then washed 3× with TBST (50 mM Tris HCl, pH 7.4, 150 mM NaCl, 0.1% TWEEN 20), blocked with 300 µL/well StartingBlock T20 (Pierce cat #37543), and incubated 45-60 minutes at room temperature (RT). The plate was washed 3 times with TBST and 0.2 µg of a biotinylated preparation of LukE protein (in 100 µL) was added to each test well. The plate was incubated 45-60 minutes at RT with gentle shaking. The plate was then washed 3 times with TBST. In separate dilution plates, the mAb test articles were serially diluted four-fold in blocking buffer starting at 10 µg/mL. Titrated test articles (100 µL) were added to test wells and the plate incubated 45-60 minutes at RT with gentle shaking. The plate was then washed 3 times with TBST. For detection of bound test articles, 100 µL/well of a peroxidase-conjugated, F(ab')2 fragment of a goat anti-mouse IgG, FC-γ fragment specific antibody (Jackson Immuno Research product 115-036-071) diluted 1:5000 in Starting block T20 was added and the plate incubated for 45-60 min at RT with gentle shaking. The plate was then washed 3 times with TBST. To detect bound F(ab')2 fragment of the goat anti-mouse antibody, 100 µL/well of the POD Chemiluminescence substrate (Roche-cat #11582950001) was added immediately prior to reading plates and the plates read using an Envision reader within 15 minutes of the substrate addition. The data were analyzed using GraphPad Prism. Values were transformed to a log scale and fit using a non-linear regression sigmoidal dose-response equation resulting in an 12-point binding curve for each antibody against each antigen.

Determination of affinity ($K_D$) constants.

$K_D$ values for LukE were determined by Bio-Layer Interferometry (BLI) using an Octet$^{RED}$ 384 instrument (forteBIO Inc.) running the basic kinetics protocol ("Biomolecular Binding Kinetics Assays on the Octet Platform", as outlined in Application Note 14 from Pall forteBIO Corp. accessible via the ForteBIO website). Briefly, biotinylated LukE protein was loaded onto Dip and Read™ Streptavidin (SA) Biosensor pins at a 10 µg/mL concentration in PBS pH7.2 for 5 minutes. A baseline was set by washing with phosphate buffered saline (PBS, pH 7.2) for 1 minute. The association rates for mAbs SM1B318, SM1B332 and SM1B507 were measured by addition of a 10 µg/mL concentration in PBS (pH7.2) over a period of 5 minutes. Following initial binding of either the SM1B318, SM1B332 or the SM1B507 mAb, a baseline was reset by washing with phosphate buffered saline (PBS, pH 7.2) for 1 minute. Binding of the second mAb was measured by addition of a 10 µg/mL concentration in PBS (pH7.2) over a period of 5 minutes. Curve fitting to determine $K_D$ values used the initial 30 seconds of association and 30 seconds of dissociation to analyze on and off rates.

LukED Neutralization Studies.

For LukED neutralization studies, the anti-LukE mAbs plus the anti-LukD mAb (each 0.625 µg/mL) were incubated with purified, recombinant LukED (2.5 µg/mL per subunit; 72.5 nM) for 30 mins at 4° C. Freshly isolated human primary polymorphonuclear leukocytes (hPMNs, 200,000 cells in RPMI+10 mM HEPES+0.1% HSA) were then added to the mixture of LukED and mAb protein to a final volume of 100 µl. Ethidium bromide was then added to the cells at 1:2000 final dilution and plates were read 30 and 60 mins post toxin addition. Following 1 hour intoxication in a 37° C. CO2 incubator, 25 µl of supernatant was carefully transferred to a new plate after spinning the plate down at 1500 RPM for 10 mins. Cell Titer reagent (Promega) was added to the remaining cells and incubated for 1.5 hours. LDH released into the culture medium was measured with a 10-minute coupled enzymatic assay that results in the conversion of resazurin into a fluorescent resorufin product. For the neutralization experiments, LukED was used at a concentration of 72.5 nM (2.5 µg/mL per subunit).

Results.

Figure 3A:
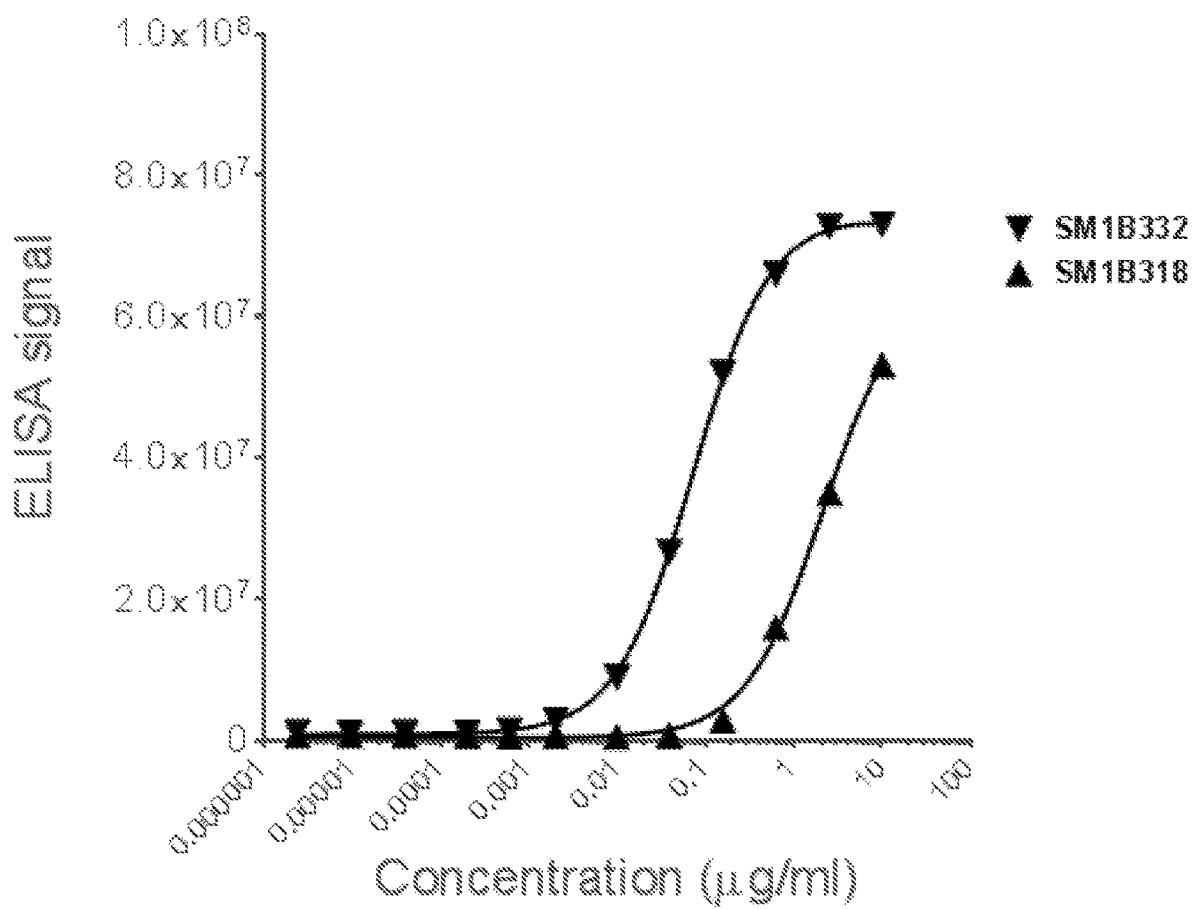
FIGS. 3A-E depict the characterization of monoclonal antibodies that bind leukotoxin subunit LukE via non-competing epitopes.

The binding of the anti-LukE mAbs SM1B318 and SM1B332 to purified LukE protein as determined by an ELISA assay is shown in FIG. 3A. For SM1B332, saturation binding is apparent at a concentration of ~1 µg/mL under these conditions with half maximal binding at ~0.05 µg/mL. Under these conditions, lower relative affinity is apparent for the SM1B318 mAb compared to SM1B332.

Figure 3B:
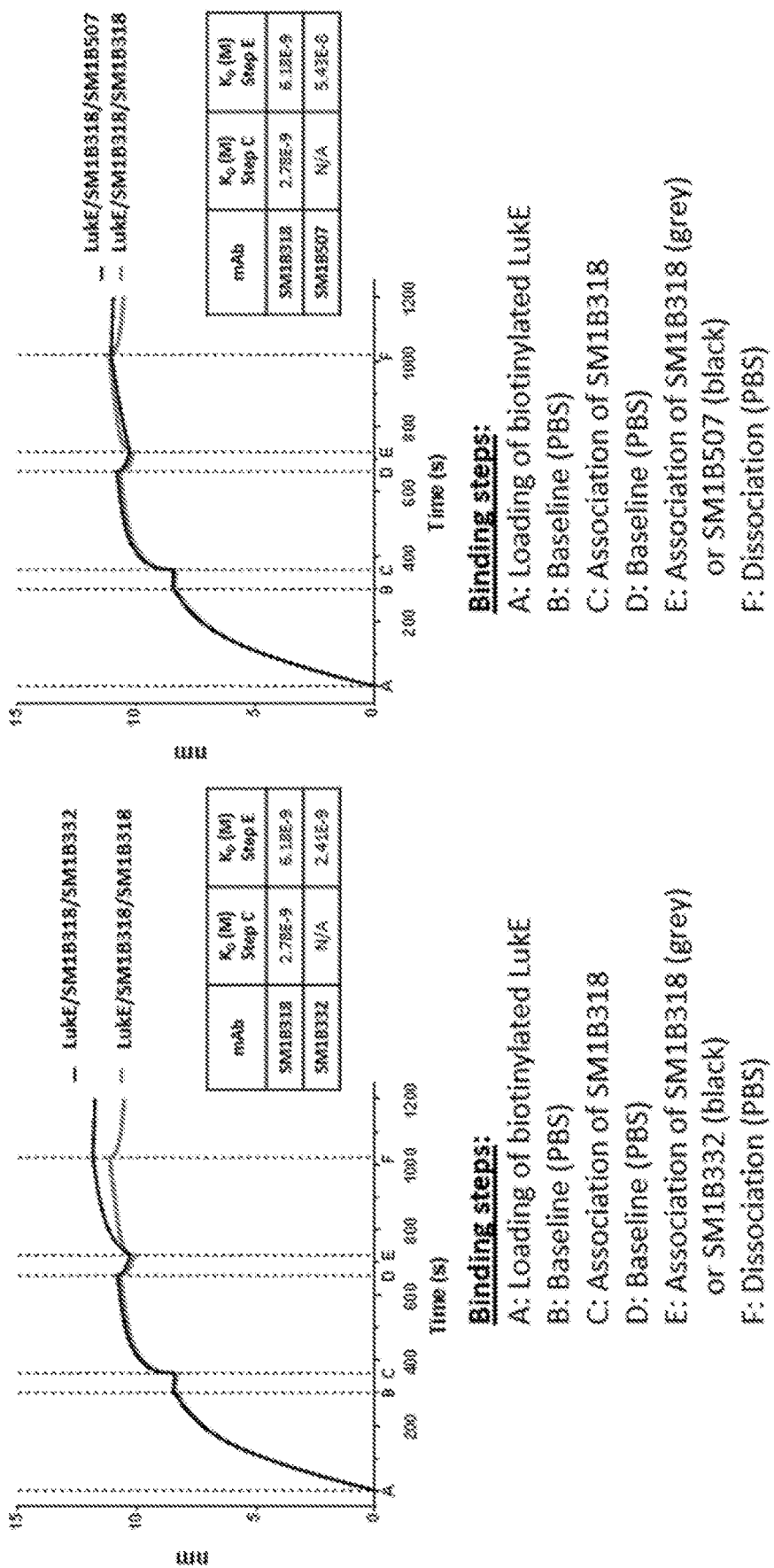

If the anti-LukE mAbs SM1B318, SM1B332 and SM1B507 bind LukE through distinct binding sites, then it would be expected that they would not exhibit competition in binding and this was assessed by Bio-Layer Interferometry (BLI). FIG. 3B shows the BLI trace for an experiment wherein a biotinylated variant of LukE was first loaded to apparent saturation onto a streptavidin-coated biosensor pin followed by near saturation binding of the SM1B318 mAb. After a PBS wash, either SM1B318, SM1B332 or SM1B507 was then added and binding measured for a further five minutes. As expected, minimal additional binding of SM1B318 was detected. However, addition of SM1B332 resulted in a further increase in the BLI signal indicating that the LukE protein immobilized on the pin displays the SM1B332 binding epitope in the presence of saturation binding of the SM1B318 mAb.

Figure 3C:
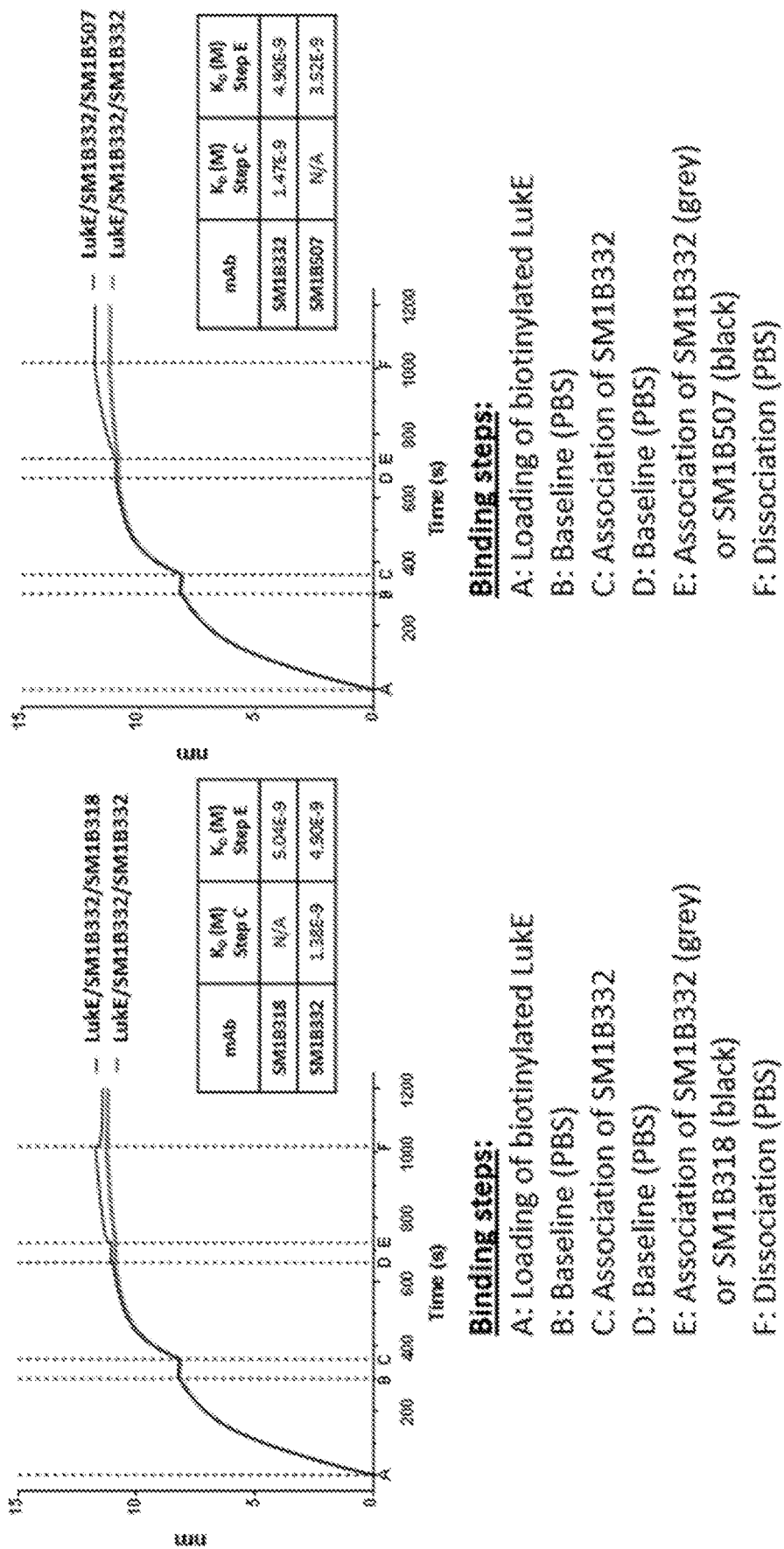

FIG. 3C shows the BLI trace for an experiment wherein a biotinylated variant of LukE was first loaded to apparent saturation onto a streptavidin-coated biosensor pin followed by near saturation binding of the SM1B332 mAb. After a PBS wash, either SM1B318 or SM1B507 was then added and binding measured for a further five minutes. As expected, minimal additional binding of SM1B332 was detected. However, addition of SM1B318 or SM1B507 resulted in a further increase in the BLI signal indicating that the LukE protein immobilized on the pin displays the SM1B318 and SM1B507 binding epitopes in the presence of saturation binding of the SM1B332 mAb. These BLI data clearly indicate that the anti-LukE mAbs SM1B318 and SM1B507 bind LukE through distinct and non-competing binding sites in comparison to the SM1B332 mAb.

Figure 3D:
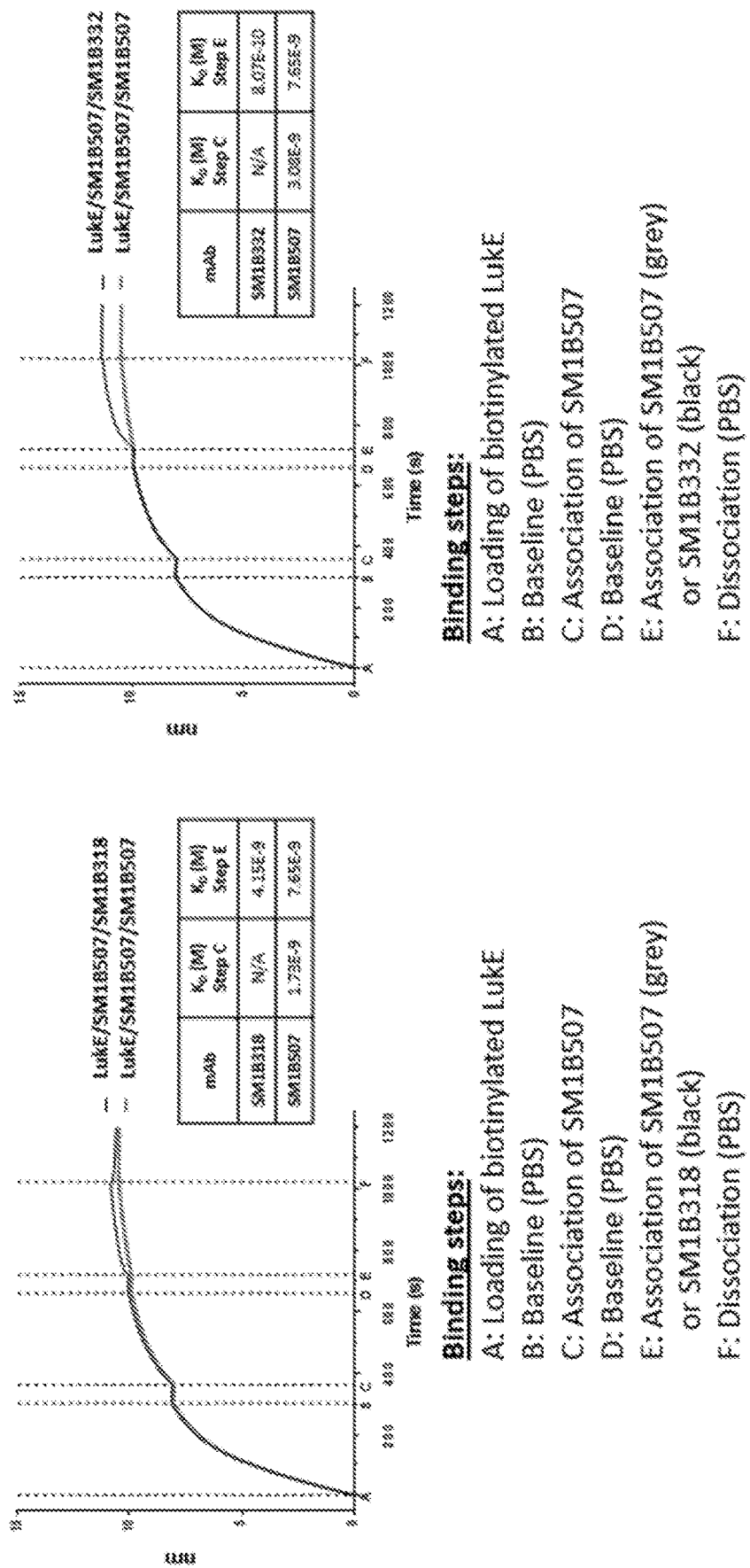

FIG. 3D shows the BLI trace for an experiment wherein a biotinylated variant of LukE was first loaded to apparent saturation onto a streptavidin-coated biosensor pin followed by near saturation binding of the SM1B507 mAb. After a PBS wash, either SM1B318 or SM1B332 was then added and binding measured for a further five minutes. As expected, minimal additional binding of SM1B507 was detected. However, addition of SM1B318 or SM1B332 resulted in a further increase in the BLI signal indicating that the LukE protein immobilized on the pin displays the SM1B318 and SM1B332 binding epitopes in the presence of saturation binding of the SM1B507 mAb. These BLI data clearly indicate that the anti-LukE mAbs SM1B318 and SM1B332 bind LukE through distinct and non-competing binding sites in comparison to the SM1B507 mAb.

Figure 3E:
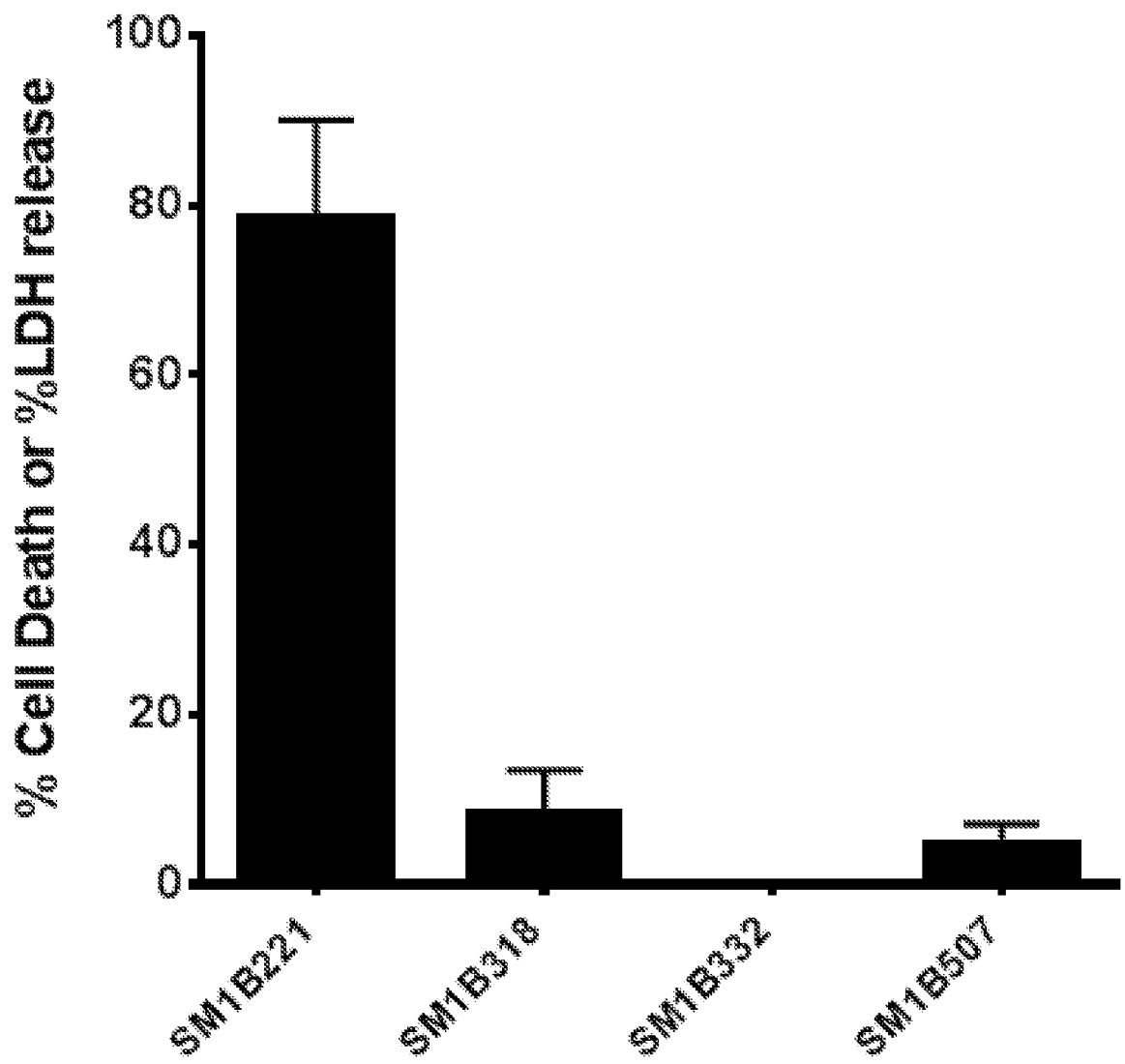

The relative ability of the anti-LukE mAbs SM1B318, SM1B332 and SM1B507 plus the anti-LukD mAb SM1B221 to inhibit the cytolytic activity of LukED against hPMNs was as determined by LDH release from lysed cells is shown in FIG. 3E. In contrast to the minimal protection from cytolysis of hPMNs that is apparent with SM1B221 (targeting LukD), each of the anti-LukE mAbs exhibited potent LukED neutralization activity.

Summary

These data indicate that anti-LukE mAbs that exhibit functional LukED neutralization activity can be identified that bind the target antigen via different, discrete epitopes and imply that alternate mechanisms of target neutralization can be achieved.

Example 5—Characterization of Monoclonal Antibodies that Bind Leukotoxin Subunit LukD and Exhibit Differential LukED Neutralization Activity To identify the specific epitopes of the three distinct anti-LukE monoclonal antibodies (mAbs) described in Example 4, Fabs were prepared that include the HC variable domain sequences of each mAb and employed in solution phase hydrogen/deuterium exchange-Mass Spectrometry (HDX-MS) studies with recombinant, purified LukE protein. Herein we describe the identification of both distinct and overlapping components of the epitopes recognized by SM1B438 (SEQ ID NOs: 1309 HC plus SEQ ID NO: 1313 LC the Fab corresponding to mAb SM1B318), SM1B440 (SEQ ID NOs: 1311 HC plus SEQ ID NO: 1315 LC the Fab corresponding to mAb SM1B332) and SM1B709 (SEQ ID NOs: 1298 HC plus SEQ ID NO: 1301 LC the Fab corresponding to mAb SM1B507).

Procedures.

Proteins. Fab proteins SM1B438, SM1B440 and SM1B709, each bearing a poly-histidine affinity tag on the carboxyl-terminus of the HC component, were purified from transiently transfected Expi293F cells (ThermoFisher Scientific Inc.) by Nickel affinity chromatography. A recombinant derivative of the LukE protein (SEQ ID NO: 826) that bears an amino-terminal poly-histidine affinity tag and was purified from *E. coli* by Nickel affinity chromatography.

HDX-MS epitope mapping HDX-MS studies were conducting using published methods (Hamuro, Y., et al., 'Rapid Analysis of Protein Structure and Dynamics by Hydrogen/Deuterium Exchange Mass Spectrometry', Journal of Biomolecular Techniques 14(3): 171-182 (2003) and Horn, J. R., et al., 'The Role of Protein Dynamics in Increasing Binding Affinity for an Engineered Protein-Protein Interaction Established by H/D Exchange Mass Spectrometry', Biochemistry 45: 8488-8498 (2006), which are hereby incorporated by reference in their entirety). Briefly, the recombinant LukE protein in the absence or presence of Fabs were incubated in a deuterated water solution for predetermined times resulting in deuterium incorporation at exchangeable hydrogen atoms. Regions bound to the Fab proteins were inferred to be those sites relatively protected from exchange and thus contain a lower fraction of deuterium than the reference LukE protein. The deuterium exchange was carried at room temperature for 0s, 60 sec, 300 sec, 1800 sec, 7200 sec, and 14400 sec. Following proteolysis, deuterium levels of the identified LukE peptides were monitored by the corresponding mass shift as determined by LC/MS.

Results.

FIG. 4 shows data from HDX-MS analysis of the binding of Fabs SM1B438, SM1B440 and SM1B709 to LukE protein with the regions of LukE that were protected from Hydrogen/Deuterium exchange identified (as per the LukE numbering of SEQ ID NO: 826). In accord with the data generated from the afore described BLI studies undertaken with the corresponding mAb proteins (as described in Example 4, FIGS. 3B, 3C and 3D), it is apparent that the non-linear epitopes recognized by each Fab (and presumably therein the corresponding mAbs) are distinct with only one overlapping linear epitope component in the C-terminus of LukE (corresponding to amino acid residues 207-219 of SEQ ID NO: 826).

Summary.

These data further exemplify that mAbs capable of neutralizing the cytolytic activity of leukotoxin ED can do so through the recognition of distinct epitopes on LukE and support the notion that neutralization can be achieved via discrete mechanisms.

TABLE 19

LukAB Light Chain (LC) and Heavy Chain (HC) Amino Acid Sequences

| mAb/Fab name | Region | Sequence | SEQ ID NO: |
|---|---|---|---|
| SM1B105 | LC | DIVLTQSPAIMAASLGQKVTMTCSASSSVSSSYLHWYQQKS GASPKPLIHRTSNLASGVPARFSGSGSGTSYSLTISSVEAEDD ATYYCQQWSGYPFTFGAGTKLELKRADAAPTVSIFPPSSEQL TSGGASVVCFLNNFYPKDINVKWKIDGSERQNGVLNSWTD QDSKDSTYSMSSTLTLTKDEYERHNSYTCEATEIKTSTSPIVK SFNRNEC | 218 |
| SM1B106 | LC | DIVIVITQSPASLAVSLGQRATISCRASESVDNSGISFMNWFQQ KPGQPPKLLIYAASNQGSGVPARFSGSGSGTDFSLNIHPMEE DDTAMYFCQQSKEVPYTFGGGTKLEIKRADAAPTVSIFPPSS EQLTSGGASVVCFLNNFYPKDINVKWKIDGSERQNGVLNS WTDQDSKDSTYSMSSTLTLTKDEYERHNSYTCEATEIKTSTS PIVKSFNRNEC | 219 |
| SM1B107 | LC | DIVLTQSPASLAVSLGQRATISCRASESVDNSGISFMNWFQQ KPGQPPKLLIYAASNQGSGVPARFSGSGSGTDFSLNIHPMEE DDTAMYFCQQSKEVPYTFGGGTKLEIKRADAAPTVSIFPPSS EQLTSGGASVVCFLNNFYPKDINVKWKIDGSERQNGVLNS WTDQDSKDSTYSMSSTLTLTKDEYERHNSYTCEATEIKTSTS PIVKSFNRNEC | 220 |
| SM1B108 | LC | DVVMTQTPKFLLVSAGDRVTITCKASQSVSDDVTWYQQKS GQSPKLLIYYASNRYTGVPDRFTGSGYGTDFTFTISTVQAED LAVYFCQQDYSSPWTFGGGTKLEIKRADAAPTVSIFSPSSEQ LTSGGASVVCFLNNFYPKDINVKWKIDGSERQNGVLNSWT DQDSKDSTYSMSSTLTLTKDEYERHNSYTCEATHKTSTSPIV KSFNRNEC | 221 |
| SM1B109 | LC | DIVMTQSPASLAVSLGQRATISCRASESVDNSGISFMNWFQQ KPGQPPKLLIYAASNQGSGVPARFSGSGSGTDFSLNIHPMEE DDTAMYFCQQSKEVPYTFGGGTKLEIKRADAAPTVSIFPPSS EQLTSGGASVVCFLNNFYPKDINVKWKIDGSERQNGVLNS WTDQDSKDSTYSMSSTLTLTKDEYERHNSYTCEATHKTSTS PIVKSFNRNEC | 222 |
| SM1B110 | LC | DIVLTQSPAIMSASPGEKVTITCSASSSVSYMHWFQQKPGTS PKLWIYSTSNLASGVPARFSGSGSGTSYSLTISRMEAEDAAT YYCQQRSSYPFTFGSGTKLEIKRADAAPTVSIFPPSSEQLTSG GASVVCFLNNFYPKDINVKWKIDGSERQNGVLNSWTDQDS KDSTYSMSSTLTLTKDEYERHNSYTCEATHKTSTSPIVKSFN RNEC | 223 |
| SM1B111 | LC | DIVMTQSPTTMAASPGERITITCSAHSNLISNYLHWYQQKPG FSPKLLIYRTSNLASGVPARFSGSGSGTSYSLTIGTMEAEDVA TYFCQQGSSIPFTFGSGTKLEIKRADAAPTVSIFPPSSEQLTSG GASVVCFLNNFYPKDINVKWKIDGSERQNGVLNSWTDQDS KDSTYSMSSTLTLTKDEYERHNSYTCEATHKTSTSPIVKSFN RNEC | 224 |
| SM1B112 | LC | QIVLTQSPTIMSASPGEKVTMTCSASSHVSIYWYQQKPGSS PRLWIYDTSNLVSGVPARFSGSRSGTSYSLTISSMEADAAT YYCQQYSGYPYTFGGGTKLEIKRADAAPTVSIFPPSSEQLTS GGASVVCFLNNFYPKDINVKWKIDGSERQNGVLNSWTDQD SKDSTYSMSSTLTLTKDEYERHNSYTCEATHKTSTSPIVKSF NRNEC | 225 |
| SM1B243 | LC | DIKMTQSPSSMYASLGERVTITCKASQDINSYLSWFQQKPG KSPKTLIYRANRLVDGVPSRFSGSGSGQDYSPTISSLEYEDM GIYYCLQYDEFPYTFGGGTKLEIKRADAAPTVSIFPPSSEQLT SGGASVVCFLNNFYPKDINVKWKIDGSERQNGVLNSWTDQ DSKDSTYSMSSTLTLTKDEYERHNSYTCEATEIKTSTSPIVKS FNRNEC | 226 |
| SM1B244 | LC | DIVMTQSQKFMSTSVGDRVSVTCKASQNVGTNVAWYQQK PGQSPKTLIYSASYRYSGVPDSFTGSGSGTDFTLTISNVQSED WAEYFCQQYNSYPFTFGSGTKLEIKRADAAPTVSIFPPS | 227 |

TABLE 19-continued

LukAB Light Chain (LC) and Heavy Chain (HC) Amino Acid Sequences

| mAb/Fab name | Region | Sequence | SEQ ID NO: |
|---|---|---|---|
| | | LTSGGASVVCFLNNFYPKDINVKWKIDGSERQNGVLNSWT DQDSKDSTYSMSSTLTLTKDEYERHNSYTCEATHKTSTSPIV KSFNRNEC | |
| SM1B245 | LC | DIVLTQSPASLAVSLGQRATMSCRASESVDGYGNSFLHWYQ QKPGQPPKLLIYRASNLESGIPARFSGTGSRTDFTLTITPVEA DDVATYYCQQSNGDPFTFGSGTKLEIKRADAAPTVSIFPPSS EQLTSGGASVVCFLNNFYPKDINVKWKIDGSERQNGVLNS WTDQDSKDSTYSMSSTLTLTKDEYERHNSYTCEATHKTSTS PIVKSFNRNEC | 228 |
| SM1B246 | LC | DVLMTQTPLSLPVSLGDQASISCRSSQSIVHSNGKTYLEWYL QKPGQSPKLLIYKVSNRFSGVPDRFSGSGSGTDFTLKISRVE AEDLGVYYCLQGSHVPWTFGGGTKLELKRADAAPTVSIFPP SSEQLTSGGASVVCFLNNFYPKDINVKWKIDGSERQNGVLN SWTDQDSKDSTYSMSSTLTLTKDEYERHNSYTCEATHKTST SPIVKSFNRNEC | 229 |
| SM1B247 | LC | DIVLTQSPASLAVSLGQRATISCRASKSVSISGYSYMEIWYQQ KPGQPPKLLIDLASNLESGVPARFSGSGSGTDFTLNIEIPVEEE DAATYYCQHSRELPFTFGSGTKLEIKRADAAPTVSIFPPSSEQ LTSGGASVVCFLNNFYPKDINVKWKIDGSERQNGVLNSWT DQDSKDSTYSMSSTLTLTKDEYERHNSYTCEATHKTSTSPIV KSFNRNEC | 230 |
| SM1B248 | LC | DIVLTQSPASLAVSLGQRATMSCRASESVDGYGNSFLHWYQ QKPGQPPKLLIYRASNLESGIPARFSGTGSRTDFTLTITPVEA DDVATYYCQQSNGDPFTFGSGTKLEIKRADAAPTVSIFPPSS EQLTSGGASVVCFLNNFYPKDINVKWKIDGSERQNGVLNS WTDQDSKDSTYSMSSTLTLTKDEYERHNSYTCEATHKTSTS PIVKSFNRNEC | 231 |
| SM1B249 | LC | QIVLTQSPAIMSASPGEKVTMTCSASSSVSYMEIWYQQKSGT SPKRWIYDTSKLASGVPARFSGSGSGTSYSLTISSMEAEDAA TYYCQQWISNPPTFGGGTKLEIKRADAAPTVSIFPPSSEQLTS GGASVVCFLNNFYPKDINVKWKIDGSERQNGVLNSWTDQD SKDSTYSMSSTLTLTKDEYERHNSYTCEATHKTSTSPIVKSF NRNEC | 232 |
| SM1B250 | LC | DIVLTQSPASLAVSLEQRATISCKASQSVDYDGDSYMNWYQ QKPGQPPKLLIYAASNLESGIPARFSGSGSGTDFTLNIHPVEE EDAATYYCQQSNEDPLTFGAGTKLELKRADAAPTVSIFPPSS EQLTSGGASVVCFLNNFYPKDINVKWKIDGSERQNGVLNS WTDQDSKDSTYSMSSTLTLTKDEYERHNSYTCEATHKTSTS PIVKSFNRNEC | 233 |
| SM1B251 | LC | DIQMTQSPASLSASVGETVTTICRASENIYSYLAWYQQKQG KSPQLLVYNAKTLVEGVPSRFSGSGSGTQFSLKINSLQPEDF GSYYCQHHYGSPYTFGGGTKLELKRADAAPTVSIFPPSSEQL TSGGASVVCFLNNFYPKDINVKWKIDGSERQNGVLNSWTD QDSKDSTYSMSSTLTLTKDEYERHNSYTCEATEIKTSTSPIVK SFNRNEC | 234 |
| SM1B252 | LC | DVLMTQTPLSLPVSLGDQASISCRSSQSIVYSNGNTYLEWYL QKPGQSPKLLIYKVSNRFSGVPDRFSGSGSGTDFTLKISRVE AEDLGVYYCFQGSHVPPTFGSGTKLEIKRADAAPTVSIFPPSS EQLTSGGASVVCFLNNFYPKDINVKWKIDGSERQNGVLNS WTDQDSKDSTYSMSSTLTLTKDEYERHNSYTCEATHKTSTS PIVKSFNRNEC | 235 |
| SM1B253 | LC | DVVMTQTPLTLSVTIGQAASISCKSSQSLLHSDGKTYLNWIL QRPGQSPKRLIYLVSKLDSGVPDRFTGSGSGTDFTLKISRVE AEDLGVYYCWQGTHFPYTFGGGTKLEIKRADAAPTVSIFPP SSEQLTSGGASVVCFLNNFYPKDINVKWKIDGSERQNGVLN SWTDQDSKDSTYSMSSTLTLTKDEYERHNSYTCEATHKTST SPIVKSFNRNEC | 236 |
| SM1B254 | LC | DVVMTQTPLTLSVTVGQPASISCKSSQSLLHSDGKTYLNWL LQRPGQSPKRLIYLVSKLDSGVPDRFTGSGSGTDFTLKISRVE AEDLGVYYCWQGTHFPYTFGGGTKLEIKRADAAPTVSIFPP SSEQLTSGGASVVCFLNNFYPKDINVKWKIDGSERQNGVLN SWTDQDSKDSTYSMSSTLTLTKDEYERHNSYTCEATHKTST SPIVKSFNRNEC | 237 |

TABLE 19-continued

LukAB Light Chain (LC) and Heavy Chain (HC) Amino Acid Sequences

| mAb/Fab name | Region | Sequence | SEQ ID NO: |
|---|---|---|---|
| SM1B255 | LC | DVVMTQTPLTLSVTIGQPASISCKSSQSLLDSDGETYLNWLL QRPGQSPKRLIYMVSKLDSGVPDRFTGSGSGTDFTLKISRVE AEDLGVYYCWQGTHFPQTFGGGTKLELKRADAAPTVSIFPP SSEQLTSGGASVVCFLNNFYPKDINVKWKIDGSERQNGVLN SWTDQDSKDSTYSMSSTLTLTKDEYERHNSYTCEATHKTST | 238 |
| SM1B256 | LC | SPIVKSFNRNEC DVVMTQTPLTLSVTNGQPASISCKSSQSLLDSDGETYLNWL LQRPGQSPKRLIYLVSKLDSGVPDRFIGSGSGTDFTLKISRVE AEDLGVYFCWQGTHSPYTFGGGTKLEIKRADAAPTVSIFPPS SEQLTSGGASVVCFLNNFYPKDINVKWKIDGSERQNGVLNS WTDQDSKDSTYSMSSTLTLTKDEYERHNSYTCEATHKTSTS PIVKSFNRNEC | 239 |
| SM1B257 | LC | DIQMTQSPSSLSASLGGKVTITCKASQDINKYIAWYQHKPGK GPRLLIHYTSTLQPGIPSRFSGSGSGRDYSFSISNLEPEDIATY YCLQYDNLRTFGGGTKVEIKRADAAPTVSIFPPSSEQLTSGG ASVVCFLNNFYPKDINVKWKIDGSERQNGVLNSWTDQDSK DSTYSMSSTLTLTKDEYERHNSYTCEATHKTSTSPIVKSFNR NEC | 240 |
| SM1B258 | LC | DVLMTQTPLSLPVSLGDQASISCRSSQSIVHSNGNTYLEWYL QKPGQSPKLLIYKVSNRFSGVPDRFSGSGSGTDFTLKISRVE AEDLGVYYCFQGSHVPFTFGSGTKLEIKRADAAPTVSIFPPSS EQLTSGGASVVCFLNNFYPKDINVKWKIDGSERQNGVLNS WTDQDSKDSTYSMSSTLTLTKDEYERHNSYTCEATHKTSTS PIVKSFNRNEC | 241 |
| SM1B259 | LC | QIVLTQSPAIMSASPGEKVTMTCSASSSVSYMYWYQQKPGS SPRLLIYDTSNLASGVPVRFSGSGSGTSYSLTISRMEAEDAAT YYCQQWSSYPPTFGGGTKLEIKRADAAPTVSIFPPSSEQLTS GGASVVCFLNNFYPKDINVKWKIDGSERQNGVLNSWTDQD SKDSTYSMSSTLTLTKDEYERHNSYTCEATHKTSTSPIVKSF NRNEC | 242 |
| SM1B260 | LC | DIVLTQSPASLAVSLGQRATMSCRASESVDGYGNSFLHWYQ QKPGQPPKLLIYRASNLESGIPARFSGTGSRTDFTLTITPVEA DDVATYYCQQSNGDPFTFGSGTKLEIKRADAAPTVSIFPPSS EQLTSGGASVVCFLNNFYPKDINVKWKIDGSERQNGVLNS WTDQDSKDSTYSMSSTLTLTKDEYERHNSYTCEATHKTSTS PIVKSFNRNEC | 243 |
| SM1B261 | LC | NIVMTQSPKSMSMSVGERVTLSCKASENVGTYVSWYQQKP EQSPKLLIYGASNRYTGVPERFTGSGSATDFTLTISSVQAEDL ADYHCGQSYSYPLTFGAGTKLELKRADAAPTVSIFPPSSEQL TSGGASVVCFLNNFYPKDINVKWKIDGSERQNGVLNSWTD QDSKDSTYSMSSTLTLTKDEYERHNSYTCEATEIKTSTSPIVK SFNRNEC | 244 |
| SM1B262 | LC | DIKMTQSPSSMYASLGERVTITCKASQDINSYLSWFQQKPG KSPKTLIYRANRLVDGVPSRFSGSGSGQDYSLTISSLEYEDM GIYYCLQYDEFPLTFGAGTKLELKRADAAPTVSIFPPSSEQLT SGGASVVCFLNNFYPKDINVKWKIDGSERQNGVLNSWTDQ DSKDSTYSMSSTLTLTKDEYERHNSYTCEATEIKTSTSPIVKS FNRNEC | 245 |
| SM1B263 | LC | DIQMTQSPSSLSASLGGKVTITCKASQDINKYIAWYQHKPGK GPRLLIHYTSTLQPGIPSRFSGSGSGRDYSFSISNLEPEDIATY YCLQYDNLWTFGGGTKVEIKRADAAPTVSIFPPSSEQLTSGG ASVVCFLNNFYPKDINVKWKIDGSERQNGVLNSWTDQDSK DSTYSMSSTLTLTKDEYERHNSYTCEATHKTSTSPIVKSFNR NEC | 246 |
| SM1B264 | LC | DIQMTQSPASLSASVGETVTIICRASENIYSNLAWYQQKQGK SPQLLVYAATNLADGMPSRFSGSGSGTQYSLKINSLQSEDFG SYYCQHFWGTPWTFGGGTKLEIKRADAAPTVSIFPPSSEQLT SGGASVVCFLNNFYPKDINVKWKIDGSERQNGVLNSWTDQ DSKDSTYSMSSTLTLTKDEYERHNSYTCEATEIKTSTSPIVKS FNRNEC | 247 |
| SM1B265 | LC | DIQMTQSPASLSASVGETVTIICRASENIYSLAWYQQKQGK SPQLLFYNAKTLVEGVPSRFSGSGSGTQFSLKINSLQPEDFGS YYCQHHYGSPYTFGGGTKLELKRADAAPTVSIFPPSSEQLTS GGASVVCFLNNFYPKDINVKWKIDGSERQNGVLNSWTDQD | 248 |

TABLE 19-continued

LukAB Light Chain (LC) and Heavy Chain (HC) Amino Acid Sequences

| mAb/Fab name | Region | Sequence | SEQ ID NO: |
|---|---|---|---|
| | | SKDSTYSMSSTLTLTKDEYERHNSYTCEATHKTSTSPIVKSFNRNEC | |
| SM1B266 | LC | DIQMTQSPSTLSASLGDTITITCHASQNINVWLSWYQQKPGNIPKLLIYKASNLHTGVPSRFSGSGSGTGFTLTISSLQPEDIATYYCQQGQSYPLTFGAGTKVEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC | 249 |
| SM1B267 | LC | DIQMTQSPSTLSASLGDTITITCHASQNINVWLSWYQQKPGNIPKLLIYKASNLHTGVPSRFSGSGSGTGFTLTISSLQPEDIATYYCQQGQSYPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC | 250 |
| SM1B268 | LC | EIVLTQSPTTMAASPGEKITITCSASSSISSNYLHWYQQKPGFSPKLLIYRTSNLASGVPARFSGSGSGTSYSLTIGTMEAEDVATYYCQQGSSIPRTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC | 251 |
| SM1B269 | LC | DIVLTQSPASLAVSLGQRATISCKASQSVDYDGDSYMNWYQQKPGQPPKLLIYAASNLESGIPARFSGSGSGTDFTLNIHPVEEEDAATYYCQQSNEDPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC | 252 |
| SM1B270 | LC | DIVLTQSPASLAVSLGQRASISCKASQSVDYDGDSYMNWYQQKPGQPPKLLIYAASNLESGIPARFSGSGSGTDFTLNIHPVEEEDAATYYCQQSYEDPFTFGSGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC | 253 |
| SM1B271 | LC | QIVLTQSPAIMSASPGEKVTMTCSASSSVSYMYWYQQKPGSSPRLLIYDTSNLASGVPVRFSGSGSGTSYSLTISRMEAEDAATYYCQQWSSYPPTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC | 254 |
| SM1B272 | LC | DIVMTQSQKFMSTSVGDRVSVTCKASQNVGTNVAWYQQKPGQSPKALIYSASYRYSGVPDRFTGSGSGTDFTLTISNVQSEDLAEYFCQQYNSYPFTFGSGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATEIKTSTSPIVKSFNRNEC | 255 |
| SM1B273 | LC | DIVMSQSPSSLAVSVGEKVTMSCKSSQSLLYSSNQKNYLAWYQQKPGQSPKLLIYWASTRESGVPDRFTGSGSGTDFTLTISSVKAEDLAVYYCQQYYSYPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATEIKTSTSPIVKSFNRNEC | 256 |
| SM1B274 | LC | DVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPPYTFGGGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC | 257 |
| SM1B275 | LC | DVVMTQTPLTLSVTIGQPASISCKSSQSLLYSNGKTYLNWLLQRPGQSPKRLIYLVSKLDSGVPDRFTGSGSGTDFTLKISRVEAEDLGVFYCVQGTHFPQTFGGGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC | 258 |

TABLE 19-continued

LukAB Light Chain (LC) and Heavy Chain (HC) Amino Acid Sequences

| mAb/Fab name | Region | Sequence | SEQ ID NO: |
|---|---|---|---|
| SM1B105 | HC | EVQLQQSGAELMTPGASVKISCKATGYTFSTFWIEWIKQRP GHGLEWIGEILPGSGSTKYNEKFKGKATFTADTSSNTAYMQ LSSSLTSEDSAVYYCARGGYDGMDYWGQGTSVTVSSAKTTP PSVYPLAPGSAAQTNSMVTLGCLVKGYFPEPVTVTWNSGSL SSGVHTFPAVLESDLYTLSSSVTVPSSPRPSETVTCNVAHPAS STKVDKKIVPRDCGCKPCICTVPEVSSVFIFPPKPKDVLTITLT PKVTCVVVDISKDDPEVQFSWFVDDVEVHTAQTQPREEQFN STFRSVSELPIMIFIQDWLNGKEFKCRVNSAAFPAPIEKTISKT KGRPKAPQVYTIPPPKEQMAKDKVSLTCMITDFFPEDITVEW QWNGQPAENYKNTQPIMNTNGSYFVYSKLNVQKSNWEAG NTFTCSVLEIEGLHNEIHTEKSLSHSPGK | 259 |
| SM1B106 | HC | EVQLQQSGAELMTPGASVKISCKATGYTFSTFWIEWIKQRP GHGLEWIGEILPGSGSTKYNEKFKGKATFTADTSSNTAYMQ LSSLSSEDSAVYYCARGGYDGMDYWGQGTSVTVSSAKTTP PSVYPLAPGSAAQTNSMVTLGCLVKGYFPEPVTVTWNSGSL SSGVHTFPAVLESDLYTLSSSVTVPSSPRPSETVTCNVAHPAS STKVDKKIVPRDCGCKPCICTVPEVSSVFIFPPKPKDVLTITLT PKVTCVVVDISKDDPEVQFSWFVDDVEVHTAQTQPREEQFN STFRSVSELPIMHQDWLNGKEFKCRVNSAAFPAPIEKTISKT KGRPKAPQVYTIPPPKEQMAKDKVSLTCMITDFFPEDITVEW QWNGQPAENYKNTQPIMNTNGSYFVYSKLNVQKSNWEAG NTFTCSVLEIEGLHNEIHTEKSLSHSPGK | 260 |
| SM1B107 | HC | EVQLQQSEAELMTPGASVKISCKATGYTFSTFWIEWIKQRPG HGLEWIGEILPGSGSTKYNEKFKGKATFTADTSSNTAYMQL SSLTSEDSAVYYCARGGYDGMDYWGQGTSVTVSSAKTTPP SVYPLAPGSAAQTNSMVTLGCLVKGYFPEPVTVTWNSGSLS SGVHTFPAVLESDLYTLSSSVTVPSSPRPSETVTCNVAHPASS TKVDKKIVPRDCGCKPCICTVPEVSSVFIFPPKPKDVLTITLTP KVTCVVVDISKDDPEVQFSWFVDDVEVHTAQTQPREEQFNS TFRSVSELPIMHQDWLNGKEFKCRVNSAAFPAPIEKTISKTK GRPKAPQVYTIPPPKEQMAKDKVSLTCMITDFFPEDITVEWQ WNGQPAENYKNTQPIMNTNGSYFVYSKLNVQKSNMTEAGN TFTCSVLHEGLHNEIHTEKSLSHSPGK | 261 |
| SM1B108 | HC | EVQLQQSGAELVKPGASVKISCKASGYAFSSSWMNWVKQR PGKGLEWIGRIYPGDGDTNYHGKFKGKATLTADKSSSTAY MQLSSLTSEDSAVYFCARRNYDGYHYGMDYWGQGTSVTV SSAKTTPPSVYPLAPGSAAQTNSMVTLGCLVKGYFPEPVTV TWNSGSLSSGVHTFPAVLESDLYTLSSSVTVPSSPRPSETVTC NVAHPASSTKVDKKIVPRDCGCKPCICTVPEVSSVFIFPPKPK DVLTITLTPKVTCVVVDISKDDPEVQFSWFVDDVEVHTAQT QPREEQFNSTFRSVSELPIMHQDWLNGKEFKCRVNSAAFPA PIEKTISKTKGRPKAPQVYTIPPPKEQMAKDKVSLTCMITDFF PEDITVEWQWNGQPAENYKNTQPIMNTNGSYFVYSKLNVQ KSNWEAGNTFTCSVLEIEGLHNEIHTEKSLSHSPGK | 262 |
| SM1B109 | HC | EVQLQQSGAELMTPGASVKISCKATGYTFSTFWIEWIKQRP GHGLEWIGEILPGSGSTKYNEKFKGKATFTADTSSNTAYMQ LSSLTSEDSAVYYCARGGYDGMDYWGQGTSVTVSSAKTTP PSVYPLAPGSAAQTNSMVTLGCLVKGYFPEPVTVTWNSGSL SSGVHTFPAVLESDLYTLSSSVTVPSSPRPSETVTCNVAHPAS STKVDKKIVPRDCGCKPCICTVPEVSSVFIFPPKPKDVLTITLT PKVTCVVVDISKDDPEVQFSWFVDDVEVHTAQTQPREEQFN STFRSVSELPIMHQDWLNGKEFKCRVNSAAFPAPIEKTISKT KGRPKAPQVYTIPPPKEQMAKDKVSLTCMITDFFPEDITVEW QWNGQPAENYKNTQPIMNTNGSYFVYSKLNVQKSNWEAG NTFTCSVLEIEGLHNEIHTEKSLSHSPGK | 263 |
| SM1B110 | HC | EVQLQQSGAELVKPGTSVKMSCKASGYTFTSYWMEIWVKL RPGQGLEWIGVIDPSDSYTNYNQKFKGRATLTGDTSSSTAY MQLSSLTSEDSAVYYCTRAAYDNSYYFDYWGQGTTLTVSS AKTTPPSVYPLAPGSAAQTNSMVTLGCLVKGYFPEPVTVTW NSGSLSSGVHTFPAVLESDLYTLSSSVTVPSSPRPSETVTCNV AHPASSTKVDKKIVPRDCGCKPCICTVPEVSSVFIFPPKPKDV LTITLTPKVTCVVVDISKDDPEVQFSWFVDDVEVHTAQTQP REEQFNSTFRSVSELPIMHQDWLNGKEFKCRVNSAAFPAPIE KTISKTKGRPKAPQVYTIPPPKEQMAKDKVSLTCMITDFFPE DITVEWQWNGQPAENYKNTQPIMNTNGSYFVYSKLNVQKS NWEAGNTFTCSVLEIEGLHNEIHTEKSLSHSPGK | 264 |

TABLE 19-continued

LukAB Light Chain (LC) and Heavy Chain (HC) Amino Acid Sequences

| mAb/Fab name | Region | Sequence | SEQ ID NO: |
|---|---|---|---|
| SM1B111 | HC | EVQLQQSGAELVKPGASVKISCKASGYAFSSSWMNWLKQR PGKGLEWIGRIYPDGDTNYNGKFKGKATLTADKSSSTAY MQLSSLTSEDSAVYFCARYGYDYDGEYYYAMDYWGQGTS VTVSSAKTTPPSVYPLAPGSAAQTNSMVTLGCLVKGYFPEP VTVTWNSGSLSSGVHTFPAVLESDLYTLSSSVTVPSSPRPSET VTCNVAHPASSTKVDKKIVPRDCGCKPCICTVPEVSSVFIFPP KPKDVLTITLTPKVTCVVVDISKDDPEVQFSWFVDDVEVHT AQTQPREEQFNSTIHRSVSELPIMHQDWLNGKEFKCRVNSAA FPAPIEKTISKTKGRPKAPQVYTIPPPKEQMAKDKVSLTCMIT DFFPEDITVEWQWNGQPAENYKNTQPIMNTNGSYFVYSKL NVQKSNMTEAGNTFTCSVLEIEGLHNEIHTEKSLSHSPGK | 265 |
| SM1B112 | HC | QVQLKESGPELKKPGETVRISCKASGYTFTNYGMNWVKQT PGKGLKWIDWLKSYTGEPTHTGDFKGRFDLSLETSANTAYL QINNLKNEDTATYFCARGSLFGLDYWGQGTSVTVSSAKTTP PSVYPLAPGSAAQTNSMVTLGCLVKGYFPEPVTVTWNSGSL SSGVHTFPAVLESDLYTLSSSVTVPSSPRPSETVTCNVAHPAS STKVDKKIVPRDCGCKPCICTVPEVSSVFIFPPKPKDVLTITLT PKVTCVVVDISKDDPEVQFSWFVDDVEVHTAQTQPREEQFN STFRSVSELPIMHQDWLNGKEFKCRVNSAAFPAPIEKTISKT KGRPKAPQVYTIPPPKEQMAKDKVSLTCMITDFFPEDITVEW QWNGQPAENYKNTQPIMNTNGSYFVYSKLNVQKSNWEAG NTFTCSVLEIEGLHNEIHTEKSLSHSPGK | 266 |
| SM1B243 | HC | EVQLQQSGAELVKSGASVKLSCTASGFNIKDYYMHWVKQR PEQGLEWIGRIDPANGNTKYDPKFQDKATITSDTSSNTAYLQ LSSLTSEDTAVYYCAEGDYVPGYFDVWGAGTTVTVSSAKT TAPSVYPLAPVCGDTTGSSVTLGCLVKGYFPEPVTLTWNSG SLSSGVHTFPAVLQSDLYTLSSSVTVTSSTWPSQSITCNVAHP ASSTKVDKKIEPRGPTIKPCPPCKCPAPNLLGGPSVFIFPPKIK DVLMISLSPIVTCVVVDVSEDDPDVQISWFVNNVEVHTAQT QTEIREDYNSTLRVVSALPIQHQDWMSGKEFKCKVNNKDLP APIERTISKPKGSVRAPQVYVLPPPEEEMTKKQVTLTCMVTD FMPEDIYVEWTNNGKTELNYKNTEPVLDSDGSYFMYSKLR VEKKNWVERNSYSCSVVEIEGLHNEIHTTKSFSRTPGK | 267 |
| SM1B244 | HC | EVQLQESGPSLVKPSQTLSLTCSVTGDSITSDYWNWIRKFPG NKLEYMGYISYSGSTYYNPSLKSRISITRDTSKNQYYLQLNS VTTEDTATYYCAGDYGSPYAMDYWGQGTSVTVSSAKTTAP SVYPLAPVCGDTTGSSVTLGCLVKGYFPEPVTLTWNSGSLSS GVHTFPAVLQSDLYTLSSSVTVTSSTWPSQSITCNVAHPASS TKVDKKIEPRGPTIKPCPPCKCPAPNLLGGPSVFIFPPKIKDVL MISLSPIVTCVVVDVSEDDPDVQISWFVNNVEVHTAQTQTH REDYNSTLRVVSALPIQHQDWMSGKEFKCKVNNKDLPAPIE RTISKPKGSVRAPQVYVLPPPEEEMTKKQVTLTCMVTDFMP EDIYVEWTNNGKTELNYKNTEPVLDSDGSYFMYSKLRVEK KNWVERNSYSCSVVEIEGLHNEIHTTKSFSRTPGK | 268 |
| SM1B245 | HC | QVQLQQSGAELAKPGASVKMSCKSSGYTFSTYWMEIWVKQ RPGQGLEWIGYINPNTGYTEYNQKFKDTATLTADKSSSTAY MQLSSLTSEDSAVYYCARGGSKAFPYYAMDYWGQGTSVT VSSAKTTAPSVYPLAPVCGDTTGSSVTLGCLVKGYFPEPVTL TWNSGSLSSGVHTFPAVLQSDLYTLSSSVTVTSSTWPSQSIT CNVAHPASSTKVDKKIEPRGPTIKPCPPCKCPAPNLLGGPSV FIFPPKIKDVLMISLSPIVTCVVVDVSEDDPDVQISWFVNNVE VHTAQTQTEIREDYNSTLRVVSALPIQHQDWMSGKEFKCKV NNKDLPAPIERTISKPKGSVRAPQVYVLPPPEEEMTKKQVTL TCMVTDFMPEDIYVEWTNNGKTELNYKNTEPVLDSDGSYF MYSKLRVEKKNWVERNSYSCSVVHEGLHNEIHTTKSFSRTP GK | 269 |
| SM1B246 | HC | EIQLQQSGPELVKPGASVKMSCKASGYSFTGYNMHWVKQS HGKSLEWIGYIDPYNGATSHNQKFKGKATLTVEKSSSTAYM QLNSLTSEDSAVYYCARGLYGDYWYAYWGQGTLVTVSSA KTTAPSVYPLAPVCGDTTGSSVTLGCLVKGYFPEPVTLTWN SGSLSSGVHTFPAVLQSDLYTLSSSVTVTSSTWPSQSITCNVA HPASSTKVDKKIEPRGPTIKPCPPCKCPAPNLLGGPSVFIFPPK IKDVLMISLSPIVTCVVVDVSEDDPDVQISWFVNNVEVHTA QTQTEIREDYNSTLRVVSALPIQHQDWMSGKEFKCKVNNKD LPAPIERTISKPKGSVRAPQVYVLPPPEEEMTKKQVTLTCMV TDFMPEDIYVEWTNNGKTELNYKNTEPVLDSDGSYFMYSK LRVEKKNWVERNSYSCSVVEIEGLHNEIHTTKSFSRTPGK | 270 |

TABLE 19-continued

LukAB Light Chain (LC) and Heavy Chain (HC) Amino Acid Sequences

| mAb/Fab name | Region | Sequence | SEQ ID NO: |
|---|---|---|---|
| SM1B247 | HC | EVQLVESGGGLVKPGGSLKLSCAASGFTFSDYYMYWVRQT PEKRLEWVATISDGGSYTFYPDSVKGRFTISRDNAKNNLYL QMSSLKSEDTAMYYCARGPTYYGLDYWGQGTTLTVSSAKT TAPSVYPLAPVCGDTTGSSVTLGCLVKGYFPEPVTLTWNSG SLSSGVHTFPAVLQSDLYTLSSSVTVTSSTWPSQSITCNVAHP ASSTKVDKKIEPRGPTIKPCPPCKCPAPNLLGGPSVFIFPPKIK DVLMISLSPIVTCVVVDVSEDDPDVQISWFVNNVEVHTAQT QTEIREDYNSTLRVVSALPIQHQDWMSGKEFKCKVNNKDLP APIERTISKPKGSVRAPQVYVLPPPEEEMTKKQVTLTCMVTD FMPEDIYVEWTNNGKTELNYKNTEPVLDSDGSYFMYSKLR VEKKNWVERNSYSCSVVEIEGLHNEIHTTKSFSRTPGK | 271 |
| SM1B248 | HC | QVQLQQPGAELVRPGASVRLSCKASGYSFTSYWMSWVKVR PGQGLEWIGMIHPSDSETRLNQKFKDKATLTVDKSSSTAYM QLSSPTSEDSAVYYCARLYVDFFDYWGQGTTLTVSSAKTTA PSVYPLAPVCGDTTGSSVTLGCLVKGYFPEPVTLTWNSGSLS SGVHTFPAVLQSDLYTLSSSVTVTSSTWPSQSITCNVAHPAS STKVDKKIEPRGPTIKPCPPCKCPAPNLLGGPSVFIFPPKIKDV LMISLSPIVTCVVVDVSEDDPDVQISWFVNNVEVHTAQTQT HREDYNSTLRVVSALPIQHQDWMSGKEFKCKVNNKDLPAPI ERTISKPKGSVRAPQVYVLPPPEEEMTKKQVTLTCMVTDFM PEDIYVEWTNNGKTELNYKNTEPVLDSDGSYFMYSKLRVE KKNWVERNSYSC | 272 |
| SM1B249 | HC | DVKLVESGGGLVKLGGSLKLSCAASGFTFSSYYMSWVRQT PEKRLELVAAINSNGGSTYYPDTVKGRFTISRDNAKNTLYL QMSSLKSEDTALYYCARPDYPYAMDYWGQGTSVTVSSAKT TAPSVYPLAPVCGDTTGSSVTLGCLVKGYFPEPVTLTWNSG SLSSGVHTFPAVLQSDLYTLSSSVTVTSSTWPSQSITCNVAHP ASSTKVDKKIEPRGPTIKPCPPCKCPAPNLLGGPSVFIFPPKIK DVLMISLSPIVTCVVVDVSEDDPDVQISWFVNNVEVHTAQT QTEIREDYNSTLRVVSALPIQHQDWMSGKEFKCKVNNKDLP APIERTISKPKGSVRAPQVYVLPPPEEEMTKKQVTLTCMVTD FMPEDIYVEWTNNGKTELNYKNTEPVLDSDGSYFMYSKLR VEKKNWVERNSYSCSVVEIEGLHNEIHTTKSFSRTPGK | 273 |
| SM1B250 | HC | QIQLVQSGPELKKPGETVKISCKASGYTFTNYGMNWVKQAP GKGLKWMGWINTYTGEPTYADDFKGRFAFSLETSASTAYL QINNLKNEDTATYFCARSPSYGSRGAWFAYWSQGTLVTVS AAKTTAPSVYPLAPVCGDTTGSSVTLGCLVKGYFPEPVTLT WNSGSLSSGVHTFPAVLQSDLYTLSSSVTVTSSTWPSQSITC NVAHPASSTKVDKKIEPRGPTIKPCPPCKCPAPNLLGGPSVFI FPPKIKDVLMISLSPIVTCVVVDVSEDDPDVQISWFVNNVEV HTAQTQTHREDYNSTLRVVSALPIQHQDWMSGKEFKCKVN NKDLPAPIERTISKPKGSVRAPQVYVLPPPEEEMTKKQVTLT CMVTDFMPEDIYVEWTNNGKTELNYKNTEPVLDSDGSYFM YSKLRVEKKNWVERNSYSCSVVEIEGLHNEIHTTKSFSRTPG K | 274 |
| SM1B251 | HC | QIQLVQSGPELKKPGETVKISCKASGYTFTNYGMNWVKQAP GKGLKWMGWINTYTGEPTYADDFKGRFAFSLETSASTAYL QINNLKNEDTATYFCARSPSYGSRGAWFAYWGQGTLVTVS AAKTTAPSVYPLAPVCGDTTGSSVTLGCLVKGYFPEPVTLT WNSGSLSSGVHTFPAVLQSDLYTLSSSVTVTSSTWPSQSITC NVAHPASSTKVDKKIEPRGPTIKPCPPCKCPAPNLLGGPSVFI FPPKIKDVLMISLSPIVTCVVVDVSEDDPDVQISWFVNNVEV HTAQTQTHREDYNSTLRVVSALPIQHQDWMSGKEFKCKVN NKDLPAPIERTISKPKGSVRAPQVYVLPPPEEEMTKKQVTLT CMVTDFMPEDIYVEWTNNGKTELNYKNTEPVLDSDGSYFM YSKLRVEKKNWVERNSYSCSVVEIEGLHNEIHTTKSFSRTPG K | 275 |
| SM1B252 | HC | QVQLQQSGAELMKPGASVKISCKASGYTFSDYWIEWIKQRP GHGLEWMGEILPGSDKTNYNEKFKGKATFTADSSSNTAYM QLNSLTSEDSAVFYCATAGDDYVKWGQGTLVTVSAAKTTA PSVYPLAPVCGDTTGSSVTLGCLVKGYFPEPVTLTWNSGSLS SGVHTFPAVLQSDLYTLSSSVTVTSSTWPSQSITCNVAHPAS STKVDKKIEPRGPTIKPCPPCKCPAPNLLGGPSVFIFPPKIKDV LMISLSPIVTCVVVDVSEDDPDVQISWFVNNVEVHTAQTQT HREDYNSTLRVVSALPIQHQDWMSGKEFKCKVNNKDLPAPI ERTISKPKGSVRAPQVYVLPPPEEEMTKKQVTLTCMVTDFM PEDIYVEWTNNGKTELNYKNTEPVLDSDGSYFMYSKLRVE KKNWVERNSYSC | 276 |

TABLE 19-continued

LukAB Light Chain (LC) and Heavy Chain (HC) Amino Acid Sequences

| mAb/Fab name | Region | Sequence | SEQ ID NO: |
|---|---|---|---|
| SM1B253 | HC | EVQLQQSGAELVKPGASVKLSCTASGFNIKDTYMHWVRQR PEQGLEWIGRIDPANDITKYDPKFQGKATITADTSSNTAYLQ LSSSLTSEDTAVYYCGRDWADYWGQGTTLTVSSAKTTAPSV YPLAPVCGDTTGSSVTLGCLVKGYFPEPVTLTWNSGSLSSG VHTFPAVLQSDLYTLSSSVTVTSSTWPSQSITCNVAHPASST KVDKKIEPRGPTIKPCPPCKCPAPNLLGGPSVFIFPPKIKDVL MISLSPIVTCVVVDVSEDDPDVQISWFVNNVEVHTAQTQTH REDYNSTLRVVSALPIQHQDWMSGKEFKCKVNNKDLPAPIE RTISKPKGSVRAPQVYVLPPPEEEMTKKQVTLTCMVTDFMP EDIYVEWTNNGKTELNYKNTEPVLDSDGSYFMYSKLRVEK KNWVERNSYSCSVVEIEGLHNEIHTTKSFSRTPGK | 277 |
| SM1B254 | HC | EVQLQQSGAELVKPGASVKLSCTASGFNIKDTYMHWVKQR SEQGLEWIGRINPANDNTKYDPKFQGKATITADTSSNTAYL QLSSSLTSEDTAVYYCGRDWADYWGQGTTLTVSSAKTTAPS VYPLAPVCGDTTGSSVTLGCLVKGYFPEPVTLTWNSGSLSS GVHTFPAVLQSDLYTLSSSVTVTSSTWPSQSITCNVAHPASS TKVDKKIEPRGPTIKPCPPCKCPAPNLLGGPSVFIFPPKIKDVL MISLSPIVTCVVVDVSEDDPDVQISWFVNNVEVHTAQTQTH REDYNSTLRVVSALPIQHQDWMSGKEFKCKVNNKDLPAPIE RTISKPKGSVRAPQVYVLPPPEEEMTKKQVTLTCMVTDFMP EDIYVEWTNNGKTELNYKNTEPVLDSDGSYFMYSKLRVEK KNWVERNSYSCSVVEIEGLHNEIHTTKSFSRTPGK | 278 |
| SM1B255 | HC | QVQLQQPGAELVKPGASVKLSCKASGYTFTRYWMEIWVKQ RPGQGLEWIGEINPNNGHTNYNEKIMSRATLTVDKSSSTAY MQFNSLTSEDSAVYYCGRLDGEILYAVDYWGQGTSVTVSSA KTTAPSVYPLAPVCGDTTGSSVTLGCLVKGYFPEPVTLTWN SGSLSSGVHTFPAVLQSDLYTLSSSVTVTSSTWPSQSITCNVA HPASSTKVDKKIEPRGPTIKPCPPCKCPAPNLLGGPSVFIFPPK IKDVLMISLSPIVTCVVVDVSEDDPDVQISWFVNNVEVHTA QTQTEIREDYNSTLRVVSALPIQHQDWMSGKEFKCKVNNKD LPAPIERTISKPKGSVRAPQVYVLPPPEEEMTKKQVTLTCMV TDFMPEDIYVEWTNNGKTELNYKNTEPVLDSDGSYFMYSK LRVEKKNWVERNSYSCSVVEIEGLHNEIHTTKSFSRTPGK | 279 |
| SM1B256 | HC | QVQLQQPGTELKMPGTSVKLSCKASGYTFTTYWMEIWVKL RPGQGFEWIGEINPSNDGTNYNEKFKRKATLTVDKPSSTAY MQLSSLTSEDSTIYYCTISYYGYGDFDYWGQGTTLTVSSAK TTAPSVYPLAPVCGDTTGSSVTLGCLVKGYFPEPVTLTWNS GSLSSGVHTFPAVLQSDLYTLSSSVTVTSSTWPSQSITCNVA HPASSTKVDKKIEPRGPTIKPCPPCKCPAPNLLGGPSVFIFPPK IKDVLMISLSPIVTCVVVDVSEDDPDVQISWFVNNVEVHTA QTQTEIREDYNSTLRVVSALPIQHQDWMSGKEFKCKVNNKD LPAPIERTISKPKGSVRAPQVYVLPPPEEEMTKKQVTLTCMV TDFMPEDIYVEWTNNGKTELNYKNTEPVLDSDGSYFMYSK LRVEKKNWVERNSYSCSVVEIEGLHNEIHTTKSFSRTPGK | 280 |
| SM1B257 | HC | QVQLKESGPDLVQPSQTLSLTCTVSGFSLTSYGVHWVRQPP GKGLEWVGTMGWNDKKYYNSALKSRLSISRNTSKNQVFLK LSSSLQTEDTAMYYCTRDGDSSGSWFAYWGQGTLVTVSSAK TTAPSVYPLAPVCGDTTGSSVTLGCLVKGYFPEPVTLTWNS GSLSSGVHTFPAVLQSDLYTLSSSVTVTSSTWPSQSITCNVA HPASSTKVDKKIEPRGPTIKPCPPCKCPAPNLLGGPSVFIFPPK IKDVLMISLSPIVTCVVVDVSEDDPDVQISWFVNNVEVHTA QTQTEIREDYNSTLRVVSALPIQHQDWMSGKEFKCKVNNKD LPAPIERTISKPKGSVRAPQVYVLPPPEEEMTKKQVTLTCMV TDFMPEDIYVEWTNNGKTELNYKNTEPVLDSDGSYFMYSK LRVEKKNWVERNSYSCSVVEIEGLHNEIHTTKSFSRTPGK | 281 |
| SM1B258 | HC | QVQLKESGPDLVQPSQTLSLTCTVSGFSLTGYAVHWVRQPP GKGVEWVGTMGWDDKKFYNSALKSRLSISRDPSKNQVFFK LSSSLQTEDTAMYYCTRDHGDGGFAYWGQGTLVTVSSAKTT APSVYPLAPVCGDTTGSSVTLGCLVKGYFPEPVTLTWNSGS LSSGVHTFPAVLQSDLYTLSSSVTVTSSTWPSQSITCNVAHP ASSTKVDKKIEPRGPTIKPCPPCKCPAPNLLGGPSVFIFPPKIK DVLMISLSPIVTCVVVDVSEDDPDVQISWFVNNVEVHTAQT QTEIREDYNSTLRVVSALPIQHQDWMSGKEFKCKVNNKDLP APIERTISKPKGSVRAPQVYVLPPPEEEMTKKQVTLTCMVTD FMPEDIYVEWTNNGKTELNYKNTEPVLDSDGSYFMYSKLR VEKKNWVERNSYSCSVVEIEGLHNEIHTTKSFSRTPGK | 282 |
| SM1B259 | HC | EVQLQQSGPELVKPGASVKIPCKASGYTFTDYNMDWVKQS HGKSLEWIGNINPNNGGTIYNQNFKDRATLTVDKSSSTAYM | 283 |

TABLE 19-continued

LukAB Light Chain (LC) and Heavy Chain (HC) Amino Acid Sequences

| mAb/Fab name | Region | Sequence | SEQ ID NO: |
|---|---|---|---|
| | | ELRSLTSEDTAVYYCTRENSGYGGNYFAYWGQGTTLTVSS AKTTAPSVYPLAPVCGDTTGSSVTLGCLVKGYFPEPVTLTW NSGSLSSGVHTFPAVLQSDLYTLSSSVTVTSSTWPSQSITCNV AHPASSTKVDKKIEPRGPTIKPCPPCKCPAPNLLGGPSVFIFPP KIKDVLMISLSPIVTCVVVDVSEDDPDVQISWFVNNVEVHT AQTQTHREDYNSTLRVVSALPIQHQDWMSGKEFKCKVNNK DLPAPIERTISKPKGSVRAPQVYVLPPPEEEMTKKQVTLTCM VTDFMPEDIYVEWTNNGKTELNYKNTEPVLDSDGSYFMYS KLRVEKKNWVERNSYSCSVVEIEGLHNEIHTTKSFSRTPGK | |
| SM1B260 | HC | EVQLQQSGAELVRPGASVKLSCTTSGFNIKDSLIYWVKQRP EQGLEWIGWIDPEDGETKFAPRFQDKATITSDTSSNTAYLRL SSLTSEDTAIYYCTRSFGVCWGQGTLVTVSAAKTTAPSVYP LAPVCGDTTGSSVTLGCLVKGYFPEPVTLTWNSGSLSSGVH TFPAVLQSDLYTLSSSVTVTSSTWPSQSITCNVAHPASSTKV DKKIEPRGPTIKPCPPCKCPAPNLLGGPSVFIFPPKIKDVLMIS LSPIVTCVVVDVSEDDPDVQISWFVNNVEVHTAQTQTEIRED YNSTLRVVSALPIQHQDWMSGKEFKCKVNNKDLPAPIERTI SKPKGSVRAPQVYVLPPPEEEMTKKQVTLTCMVTDFMPEDI YVEWTNNGKTELNYKNTEPVLDSDGSYFMYSKLRVEKKN WVERNSYSCSVVHEGLHNEIHTTKSFSRTPGK | 284 |
| SM1B261 | HC | EVQLQQSGAELVRPGASVKLSCTTSGFNIKDSLIYWVKQRP EQGLEWIGWIDPEDGETKFAPRFQDKATITSDTSSNTAYLRL SSLTSEDTAIYYCTRSFGVCWGQGTLVTVSAAKTTAPSVYP LAPVCGDTTGSSVTLGCLVKGYFPEPVTLTWNSGSLSSGVH TFPAVLQSDLYTLSSSVTVTSSTWPSQSITCNVAHPASSTKV DKKIEPRGPTIKPCPPCKCPAPNLLGGPSVFIFPPKIKDVLMIS LSPIVTCVVVDVSEDDPDVQISWFVNNVEVHTAQTQTEIRED YNSTLRVVSALPIQHQDWMSGKEFKCKVNNKDLPAPIERTI SKPKGSVRAPQVYVLPPPEEEMTKKQVTLTCMVTDFMPEDI YVEWTNNGKTELNYKNTEPVLDSDGSYFMYSKLRVEKKN WVERNSYSCSVVHEGLHNEIHTTKSFSRTPGK | 285 |
| SM1B262 | HC | EVQLQQSGAELVRPGASVKLSCTTSGFNIKDSLIYWVKQRP EQGLEWIGWIDPEDGETKFAPRFQDKATITSDTSSNTAYLRL SSLTSEDTAIYYCTRSFGVCWGQGTLVTVSAAKTTAPSVYP LAPVCGDTTGSSVTLGCLVKGYFPEPVTLTWNSGSLSSGVH TFPAVLQSDLYTLSSSVTVTSSTWPSQSITCNVAHPASSTKV DKKIEPRGPTIKPCPPCKCPAPNLLGGPSVFIFPPKIKDVLMIS LSPIVTCVVVDVSEDDPDVQISWFVNNVEVHTAQTQTEIRED YNSTLRVVSALPIQHQDWMSGKEFKCKVNNKDLPAPIERTI SKPKGSVRAPQVYVLPPPEEEMTKKQVTLTCMVTDFMPEDI YVEWTNNGKTELNYKNTEPVLDSDGSYFMYSKLRVEKKN WVERNSYSCSVVHEGLHNEIHTTKSFSRTPGK | 286 |
| SM1B263 | HC | EVQLQQSGAELVRPGASVKLSCTTSGFNIKDSLIYWVKQRP EQGLEWIGWIDPEDGETKFAPRFQDKATITSDTSSNTAYLRL SSLTSEDTAIYYCTRSFGVCWGQGTLVTVSAAKTTAPSVYP LAPVCGDTTGSSVTLGCLVKGYFPEPVTLTWNSGSLSSGVH TFPAVLQSDLYTLSSSVTVTSSTWPSQSITCNVAHPASSTKV DKKIEPRGPTIKPCPPCKCPAPNLLGGPSVFIFPPKIKDVLMIS LSPIVTCVVVDVSEDDPDVQISWFVNNVEVHTAQTQTEIRED YNSTLRVVSALPIQHQDWMSGKEFKCKVNNKDLPAPIERTI SKPKGSVRAPQVYVLPPPEEEMTKKQVTLTCMVTDFMPEDI YVEWTNNGKTELNYKNTEPVLDSDGSYFMYSKLRVEKKN WVERNSYSCSVVHEGLHNEIHTTKSFSRTPGK | 811 |
| SM1B264 | HC | EVQLQQSGAELVRPGASVKLSCTTSGFNIKDSLIYWVKQRP EQGLEWIGWIDPEDGETKFAPRFQDKATITSDTSSNTAYLRL SSLTSEDTAIYYCTRSFGVCWGQGTLVTVSAAKTTAPSVYP LAPVCGDTTGSSVTLGCLVKGYFPEPVTLTWNSGSLSSGVH TFPAVLQSDLYTLSSSVTVTSSTWPSQSITCNVAHPASSTKV DKKIEPRGPTIKPCPPCKCPAPNLLGGPSVFIFPPKIKDVLMIS LSPIVTCVVVDVSEDDPDVQISWFVNNVEVHTAQTQTEIRED YNSTLRVVSALPIQHQDWMSGKEFKCKVNNKDLPAPIERTI SKPKGSVRAPQVYVLPPPEEEMTKKQVTLTCMVTDFMPEDI YVEWTNNGKTELNYKNTEPVLDSDGSYFMYSKLRVEKKN WVERNSYSCSVVHEGLHNEIHTTKSFSRTPGK | 812 |
| SM1B265 | HC | EVQLQQSGAELVRPGASVKLSCTTSGFNIKDSLIYWVKQRP EQGLEWIGWIDPEDGETKFAPRFQDKATITSDTSSNTAYLRL SSLTSEDTAIYYCTRSFGVCWGQGTLVTVSAAKTTAPSVYP LAPVCGDTTGSSVTLGCLVKGYFPEPVTLTWNSGSLSSGVH | 813 |

TABLE 19-continued

LukAB Light Chain (LC) and Heavy Chain (HC) Amino Acid Sequences

| mAb/Fab name | Region | Sequence | SEQ ID NO: |
|---|---|---|---|
| | | TFPAVLQSDLYTLSSSVTVTSSTWPSQSITCNVAHPASSTKV DKKIEPRGPTIKPCPPCKCPAPNLLGGPSVFIFPPKIKDVLMIS LSPIVTCVVVDVSEDDPDVQISWFVNNVEVHTAQTQTEIRED YNSTLRVVSALPIQHQDWMSGKEFKCKVNNKDLPAPIERTI SKPKGSVRAPQVYVLPPPEEEMTKKQVTLTCMVTDFMPEDI YVEWTNNGKTELNYKNTEPVLDSDGSYFMYSKLRVEKKN WVERNSYSCSVVHEGLHNEIHTTKSFSRTPGK | |
| SM1B266 | HC | EVQLQQSGAELVRPGASVKLSCTTSGFNIKDSLIYWVKQRP EQGLEWIGWIDPEDGETKFAPRFQDKATITSDTSSNTAYLRL SSLTSEDTAIYYCTRSFGVCWGQGTLVTVSAAKTTAPSVYP LAPVCGDTTGSSVTLGCLVKGYFPEPVTLTWNSGSLSSGVH TFPAVLQSDLYTLSSSVTVTSSTWPSQSITCNVAHPASSTKV DKKIEPRGPTIKPCPPCKCPAPNLLGGPSVFIFPPKIKDVLMIS LSPIVTCVVVDVSEDDPDVQISWFVNNVEVHTAQTQTEIRED YNSTLRVVSALPIQHQDWMSGKEFKCKVNNKDLPAPIERTI SKPKGSVRAPQVYVLPPPEEEMTKKQVTLTCMVTDFMPEDI YVEWTNNGKTELNYKNTEPVLDSDGSYFMYSKLRVEKKN WVERNSYSCSVVHEGLHNEIHTTKSFSRTPGK | 814 |
| SM1B267 | HC | EVQLQQSGAELVRPGASVKLSCTTSGFNIKDSLIYWVKQRP EQGLEWIGWIDPEDGETKFAPRFQDKATITSDTSSNTAYLRL SSLTSEDTAIYYCTRSFGVCWGQGTLVTVSAAKTTAPSVYP LAPVCGDTTGSSVTLGCLVKGYFPEPVTLTWNSGSLSSGVH TFPAVLQSDLYTLSSSVTVTSSTWPSQSITCNVAHPASSTKV DKKIEPRGPTIKPCPPCKCPAPNLLGGPSVFIFPPKIKDVLMIS LSPIVTCVVVDVSEDDPDVQISWFVNNVEVHTAQTQTEIRED YNSTLRVVSALPIQHQDWMSGKEFKCKVNNKDLPAPIERTI SKPKGSVRAPQVYVLPPPEEEMTKKQVTLTCMVTDFMPEDI YVEWTNNGKTELNYKNTEPVLDSDGSYFMYSKLRVEKKN WVERNSYSCSVVHEGLHNEIHTTKSFSRTPGK | 815 |
| SM1B268 | HC | EVQLQQSGAELVRPGASVKLSCTTSGFNIKDSLIYWVKQRP EQGLEWIGWIDPEDGETKFAPRFQDKATITSDTSSNTAYLRL SSLTSEDTAIYYCTRSFGVCWGQGTLVTVSAAKTTAPSVYP LAPVCGDTTGSSVTLGCLVKGYFPEPVTLTWNSGSLSSGVH TFPAVLQSDLYTLSSSVTVTSSTWPSQSITCNVAHPASSTKV DKKIEPRGPTIKPCPPCKCPAPNLLGGPSVFIFPPKIKDVLMIS LSPIVTCVVVDVSEDDPDVQISWFVNNVEVHTAQTQTEIRED YNSTLRVVSALPIQHQDWMSGKEFKCKVNNKDLPAPIERTI SKPKGSVRAPQVYVLPPPEEEMTKKQVTLTCMVTDFMPEDI YVEWTNNGKTELNYKNTEPVLDSDGSYFMYSKLRVEKKN WVERNSYSCSVVHEGLHNEIHTTKSFSRTPGK | 816 |
| SM1B269 | HC | EVQLQQSGAELVRPGASVKLSCTTSGFNIKDSLIYWVKQRP EQGLEWIGWIDPEDGETKFAPRFQDKATITSDTSSNTAYLRL SSLTSEDTAIYYCTRSFGVCWGQGTLVTVSAAKTTAPSVYP LAPVCGDTTGSSVTLGCLVKGYFPEPVTLTWNSGSLSSGVH TFPAVLQSDLYTLSSSVTVTSSTWPSQSITCNVAHPASSTKV DKKIEPRGPTIKPCPPCKCPAPNLLGGPSVFIFPPKIKDVLMIS LSPIVTCVVVDVSEDDPDVQISWFVNNVEVHTAQTQTEIRED YNSTLRVVSALPIQHQDWMSGKEFKCKVNNKDLPAPIERTI SKPKGSVRAPQVYVLPPPEEEMTKKQVTLTCMVTDFMPEDI YVEWTNNGKTELNYKNTEPVLDSDGSYFMYSKLRVEKKN WVERNSYSCSVVHEGLHNEIHTTKSFSRTPGK | 817 |
| SM1B270 | HC | EVQLQQSGAELVRPGASVKLSCTTSGFNIKDSLIYWVKQRP EQGLEWIGWIDPEDGETKFAPRFQDKATITSDTSSNTAYLRL SSLTSEDTAIYYCTRSFGVCWGQGTLVTVSAAKTTAPSVYP LAPVCGDTTGSSVTLGCLVKGYFPEPVTLTWNSGSLSSGVH TFPAVLQSDLYTLSSSVTVTSSTWPSQSITCNVAHPASSTKV DKKIEPRGPTIKPCPPCKCPAPNLLGGPSVFIFPPKIKDVLMIS LSPIVTCVVVDVSEDDPDVQISWFVNNVEVHTAQTQTEIRED YNSTLRVVSALPIQHQDWMSGKEFKCKVNNKDLPAPIERTI SKPKGSVRAPQVYVLPPPEEEMTKKQVTLTCMVTDFMPEDI YVEWTNNGKTELNYKNTEPVLDSDGSYFMYSKLRVEKKN WVERNSYSCSVVHEGLHNEIHTTKSFSRTPGK | 818 |
| SM1B271 | HC | EVQLQQSGAELVRPGASVKLSCTTSGFNIKDSLIYWVKQRP EQGLEWIGWIDPEDGETKFAPRFQDKATITSDTSSNTAYLRL SSLTSEDTAIYYCTRSFGVCWGQGTLVTVSAAKTTAPSVYP LAPVCGDTTGSSVTLGCLVKGYFPEPVTLTWNSGSLSSGVH TFPAVLQSDLYTLSSSVTVTSSTWPSQSITCNVAHPASSTKV DKKIEPRGPTIKPCPPCKCPAPNLLGGPSVFIFPPKIKDVLMIS | 819 |

TABLE 19-continued

LukAB Light Chain (LC) and Heavy Chain (HC) Amino Acid Sequences

| mAb/Fab name | Region | Sequence | SEQ ID NO: |
|---|---|---|---|
| | | LSPIVTCVVVDVSEDDPDVQISWFVNNVEVHTAQTQTEIRED YNSTLRVVSALPIQHQDWMSGKEFKCKVNNKDLPAPIERTI SKPKGSVRAPQVYVLPPPEEEMTKKQVTLTCMVTDFMPEDI YVEWTNNGKTELNYKNTEPVLDSDGSYFMYSKLRVEKKN WVERNSYSCSVVHEGLHNEIHTTKSFSRTPGK | |
| SM1B272 | HC | EVQLQQSGAELVRPGASVKLSCTTSGFNIKDSLIYWVKQRP EQGLEWIGWIDPEDGETKFAPRFQDKATITSDTSSNTAYLRL SSLTSEDTAIYYCTRSFGVCWGQGTLVTVSAAKTTAPSVYP LAPVCGDTTGSSVTLGCLVKGYFPEPVTLTWNSGSLSSGVH TFPAVLQSDLYTLSSSVTVTSSTWPSQSITCNVAHPASSTKV DKKIEPRGPTIKPCPPCKCPAPNLLGGPSVFIFPPKIKDVLMIS LSPIVTCVVVDVSEDDPDVQISWFVNNVEVHTAQTQTEIRED YNSTLRVVSALPIQHQDWMSGKEFKCKVNNKDLPAPIERTI SKPKGSVRAPQVYVLPPPEEEMTKKQVTLTCMVTDFMPEDI YVEWTNNGKTELNYKNTEPVLDSDGSYFMYSKLRVEKKN WVERNSYSCSVVHEGLHNEIHTTKSFSRTPGK | 820 |
| SM1B273 | HC | EVQLQQSGAELVRPGASVKLSCTTSGFNIKDSLIYWVKQRP EQGLEWIGWIDPEDGETKFAPRFQDKATITSDTSSNTAYLRL SSLTSEDTAIYYCTRSFGVCWGQGTLVTVSAAKTTAPSVYP LAPVCGDTTGSSVTLGCLVKGYFPEPVTLTWNSGSLSSGVH TFPAVLQSDLYTLSSSVTVTSSTWPSQSITCNVAHPASSTKV DKKIEPRGPTIKPCPPCKCPAPNLLGGPSVFIFPPKIKDVLMIS LSPIVTCVVVDVSEDDPDVQISWFVNNVEVHTAQTQTEIRED YNSTLRVVSALPIQHQDWMSGKEFKCKVNNKDLPAPIERTI SKPKGSVRAPQVYVLPPPEEEMTKKQVTLTCMVTDFMPEDI YVEWTNNGKTELNYKNTEPVLDSDGSYFMYSKLRVEKKN WVERNSYSCSVVHEGLHNEIHTTKSFSRTPGK | 821 |
| SM1B274 | HC | EVQLQQSGAELVRPGASVKLSCTTSGFNIKDSLIYWVKQRP EQGLEWIGWIDPEDGETKFAPRFQDKATITSDTSSNTAYLRL SSLTSEDTAIYYCTRSFGVCWGQGTLVTVSAAKTTAPSVYP LAPVCGDTTGSSVTLGCLVKGYFPEPVTLTWNSGSLSSGVH TFPAVLQSDLYTLSSSVTVTSSTWPSQSITCNVAHPASSTKV DKKIEPRGPTIKPCPPCKCPAPNLLGGPSVFIFPPKIKDVLMIS LSPIVTCVVVDVSEDDPDVQISWFVNNVEVHTAQTQTEIRED YNSTLRVVSALPIQHQDWMSGKEFKCKVNNKDLPAPIERTI SKPKGSVRAPQVYVLPPPEEEMTKKQVTLTCMVTDFMPEDI YVEWTNNGKTELNYKNTEPVLDSDGSYFMYSKLRVEKKN WVERNSYSCSVVHEGLHNEIHTTKSFSRTPGK | 822 |
| SM1B275 | HC | EVQLQQSGAELVRPGASVKLSCTTSGFNIKDSLIYWVKQRP EQGLEWIGWIDPEDGETKFAPRFQDKATITSDTSSNTAYLRL SSLTSEDTAIYYCTRSFGVCWGQGTLVTVSAAKTTAPSVYP LAPVCGDTTGSSVTLGCLVKGYFPEPVTLTWNSGSLSSGVH TFPAVLQSDLYTLSSSVTVTSSTWPSQSITCNVAHPASSTKV DKKIEPRGPTIKPCPPCKCPAPNLLGGPSVFIFPPKIKDVLMIS LSPIVTCVVVDVSEDDPDVQISWFVNNVEVHTAQTQTEIRED YNSTLRVVSALPIQHQDWMSGKEFKCKVNNKDLPAPIERTI SKPKGSVRAPQVYVLPPPEEEMTKKQVTLTCMVTDFMPEDI YVEWTNNGKTELNYKNTEPVLDSDGSYFMYSKLRVEKKN WVERNSYSCSVVHEGLHNEIHTTKSFSRTPGK | 823 |

TABLE 20

LukE Light Chain (LC) and Heavy Chain (HC) Amino Acid Sequences

| mAb/Fab name | Region | Sequence | SEQ ID NO: |
|---|---|---|---|
| SM1B507 | LC | DIVIVITQSPAIMSASPGEKVTIPCSASSSVSYMEIWFQQKPGTS PKLWIYSTSNLASGVPGRFSGSGSGTSYSLTISRMEAEDAAT YYCQQRSNYPLTFGAGTKLELKRADAAPTVSIFPPSSEQLTS GGASVVCFLNNFYPKDINVKWKIDGSERQNGVLNSWTDQD SKDSTYSMSSTLTLTKDEYERHNSYTCEATHEIKTSTSPIVKSF NRNEC | 348 |
| SM1B508 | LC | DVVMTQTPLSLPVSLGDQASISCRSSQTIVHSNGNTYLEWYL QKPGQSPKLLIYKVSNRFSGVPDRFSGSGSGTDFTLKISRVE | 349 |

TABLE 20-continued

LukE Light Chain (LC) and Heavy Chain (HC) Amino Acid Sequences

| mAb/Fab name | Region | Sequence | SEQ ID NO: |
|---|---|---|---|
| | | AEDLGVYYCFQGSHVPFTFGGGTKLEIRRADAAPTVSIFPPS SEQLTSGGASVVCFLNNFYPKDINVKWKIDGSERQNGVLNS WTDQDSKDSTYSMSSTLTLTKDEYERHNSYTCEATEIKTSTS PIVKSFNRNEC | |
| SM1B509 | LC | DIVMTQAAAIMSASPGEKVTLTCSASSSVSSSYLYWYQQKP GSSPKLWIYSTSNLASGVPARFSGSGSGTSYSLTISSMEAEDA ASYFCHQWTTFPPTFGGGTKLEIKRADAAPTVSIFPPSSEQLT SGGASVVCFLNNFYPKDINVKWKIDGSERQNGVLNSWTDQ DSKDSTYSMSSTLTLTKDEYERHNSYTCEATEIKTSTSPIVKS FNRNEC | 350 |
| SM1B510 | LC | DVVMTQTPLSLPVSLGDQASISCRSSQSLVHSNGNTYLHWY LQKPGQSPKLLIYKVSNRFSGVPDRFSGSGSGTDFTLKISRVE AEDLGVYFCSQSTHVPPTFGGGTKLEIKRADAAPTVSIFPPSS EQLTSGGASVVCFLNNFYPKDINVKWKIDGSERQNGVLNS WTDQDSKDSTYSMSSTLTLTKDEYERHNSYTCEATEIKTSTS PIVKSFNRNEC | 351 |
| SM1B511 | LC | DVVMTQTPLSLPVSLGDQASISCRSSQSLVHSNGNTYLHWY LQKPGQSPKLLIYKVSNRFSGVPDRFSGSGSGTDFTLKISRVE AEDLGVYFCSQSTHVPLTFGAGTKLELKRADAAPTVSIFPPS SEQLTSGGASVVCFLNNFYPKDINVKWKIDGSERQNGVLNS WTDQDSKDSTYSMSSTLTLTKDEYERHNSYTCEATEIKTSTS PIVKSFNRNEC | 352 |
| SM1B512 | LC | DIKMTQSPLSLPVSLGDQASISCRSSQTIVHSNGNTYLEWYL QKPGQSPKLLIYKVSNRFSGVPDRFSGSGSGTDFTLKISRVE AEDLGVYYCFQGSHVPFTFGGGTKLEIRRADAAPTVSIFPPS SEQLTSGGASVVCFLNNFYPKDINVKWKIDGSERQNGVLNS WTDQDSKDSTYSMSSTLTLTKDEYERHNSYTCEATEIKTSTS PIVKSFNRNEC | 353 |
| SM1B513 | LC | DIVLTQSPAIMSASPGEKVTITCSASSSVSYMHWFQQKPGTS PKLWIYSTSNLASGVPARFSGSGSGTSYSLTISRMEAEDAAT YYCQQRSSYPWTFGGGTKLEIKRADAAPTVSIFPPSSEQLTS GGASVVCFLNNFYPKDINVKWKIDGSERQNGVLNSWTDQD SKDSTYSMSSTLTLTKDEYERHNSYTCEATEIKTSTSPIVKSF NRNEC | 354 |
| SM1B514 | LC | DIVMTQSPSSMYASLGERVTITCKASQDINSYLSWFQQKPG KSPKTLIYRANRLVDGVPSRFSGSGSGQDYSLTISSLEYEDM GIYYCLQYDEFPYTFGGGTKLEIKRADAAPTVSIFPPSSEQLT SGGASVVCFLNNFYPKDINVKWKIDGSERQNGVLNSWTDQ DSKDSTYSMSSTLTLTKDEYERHNSYTCEATEIKTSTSPIVKS FNRNEC | 355 |
| SM1B208 | LC | DIVIVITQSPLSLPVSLGDQASISCRSSQDIVHSNGNTYLGWYL QKPGRSPKLLIYKVSNRFSGVPDRFSGSGSGTDFTLKISRVEA EDLGVYYCFQSSHFPWTFGGGTRLEIKRADAAPTVSIFPPSS EQLTSGGASVVCFLNNFYPKDINVKWKIDGSERQNGVLNS WTDQDSKDSTYSMSSTLTLTKDEYERHNSYTCEATHKTSTS PIVKSFNRNEC | 356 |
| SM1B209 | LC | DVVMTQTPLSLPVSLGDQASISCRSSQDIVHSNGNTYLGWY LQKPGRSPKLLIYKVSNRFSGVPDRFSGSGSGTDFTLKISRVE AEDLGVYYCFQSSEIFPWTFGGGTRLEIKRADAAPTVSIFPPS SEQLTSGGASVVCFLNNFYPKDINVKWKIDGSERQNGVLNS WTDQDSKDSTYSMSSTLTLTKDEYERHNSYTCEATHKTSTS PIVKSFNRNEC | 357 |
| SM1B210 | LC | DIVLTQSPLSLPVSLGDQASISCRSSQSLVHSNGNTYLHWYL QKPGQSPKLLIYKVSNRFSGVPDRFSGSGSGTDFTLKISRVE AEDLGVYFCSQSTHVPFTFGSGTKLEIKRADAAPTVSIFPPSS EQLTSGGASVVCFLNNFYPKDINVKWKIDGSERQNGVLNS WTDQDSKDSTYSMSSTLTLTKDEYERHNSYTCEATHKTSTS PIVKSFNRNEC | 358 |
| SM1B211 | LC | DIVLTQSPASLAVSLGQRATISCRASESVDSYGNSFMHWYQ QKPGQPPKLLIYRASNLESGIPARFSGSGSRTDFTLTINPVEA DDVATYYCQQSNEDPLTFGAGTKLELKRADAAPTVSIFPPSS EQLTSGGASVVCFLNNFYPKDINVKWKIDGSERQNGVLNS WTDQDSKDSTYSMSSTLTLTKDEYERHNSYTCEATHKTSTS PIVKSFNRNEC | 359 |

TABLE 20-continued

LukE Light Chain (LC) and Heavy Chain (HC) Amino Acid Sequences

| mAb/Fab name | Region | Sequence | SEQ ID NO: |
|---|---|---|---|
| SM1B507 | HC | EVQLQQSGAELVKPGASVKMSCKASGYTFTDYYMDWVKQ SHGKSFEWIGHVNPYNGDTRYNQKFKGKATLTVDKSSTTA YMELNSLTSEDSAVYYCARGNFFDYWGQGTTLSVSSAKTT PPSVYPLAPGSAAQTNSMVTLGCLVKGYFPEPVTVTWNSGS LSSGVHTFPAVLESDLYTLSSSVTVPSSPRPSETVTCNVAHPA SSTKVDKKIVPRDCGCKPCICTVPEVSSVFIFPPKPKDVLTITL TPKVTCVVVDISKDDPEVQFSWFVDDVEVHTAQTQPREEQF NSTFRSVSELPIMHQDWLNGKEFKCRVNSAAFPAPIEKTISK TKGRPKAPQVYTIPPPKEQMAKDKVSLTCMITDFFPEDITVE WQWNGQPAENYKNTQPIMNTNGSYFVYSKLNVQKSNWEA GNTFTCSVLHEGLHNEIHTEKSLSHSPGK | 360 |
| SM1B508 | HC | EVQLQQSGAELVKPGASVKISCKTSGYSFTGYFMNWVMQS HGKSLEWIGRINPYNGDTFYNQKFKGKATLTVDKSSSTAHM ELRSLASEDSAVYYCARSYGYAMDYWGQGTSVTVSSAKTT PPSVYPLAPGSAAQTNSMVTLGCLVKGYFPEPVTVTWNSGS LSSGVHTFPAVLESDLYTLSSSVTVPSSPRPSETVTCNVAHPA SSTKVDKKIVPRDCGCKPCICTVPEVSSVFIFPPKPKDVLTITL TPKVTCVVVDISKDDPEVQFSWFVDDVEVHTAQTQPREEQF NSTFRSVSELPIMHQDWLNGKEFKCRVNSAAFPAPIEKTISK TKGRPKAPQVYTIPPPKEQMAKDKVSLTCMITDFFPEDITVE WQWNGQPAENYKNTQPIMNTNGSYFVYSKLNVQKSNWEA GNTFTCSVLHEGLHNEIHTEKSLSHSPGK | 361 |
| SM1B509 | HC | QVQLKESGPGLVAPSQSLSITCTVSGFSLTGYGVNWVRQPP GKGLEWLGLMWGDGSTDYNSALNSRLRINKDNSKSQVFLK MSSLQTDDTAIYYCVRKGGNSPYAMDYWGQGTSVTVSSAK TTPPSVYPLAPGSAAQTNSMVTLGCLVKGYFPEPVTVTWNS GSLSSGVHTFPAVLESDLYTLSSSVTVPSSPRPSETVTCNVAH PASSTKVDKKIVPRDCGCKPCICTVPEVSSVFIFPPKPKDVLTI TLTPKVTCVVVDISKDDPEVQFSWFVDDVEVHTAQTQPREE QFNSTFRSVSELPIMEIQDWLNGKEFKCRVNSAAFPAPIEKTI SKTKGRPKAPQVYTIPPPKEQMAKDKVSLTCMITDFFPEDIT VEWQWNGQPAENYKNTQPIMNTNGSYFVYSKLNVQKSNW EAGNTFTCSVLHEGLHNEIHTEKSLSHSPGK | 362 |
| SM1B510 | HC | QVQLKESGPGLVAPSQSLSITCTVSGFSLTGYGVNWVRQPP GKGLEWLGLMWGDGSTDYNSALNSRLRINKDNSKSQVFLK MSSLQTDDTAIYYCVRKGGNSPYAMDYWGQGTSVTVSSAK TTPPSVYPLAPGSAAQTNSMVTLGCLVKGYFPEPVTVTWNS GSLSSGVHTFPAVLESDLYTLSSSVTVPSSPRPSETVTCNVAH PASSTKVDKKIVPRDCGCKPCICTVPEVSSVFIFPPKPKDVLTI TLTPKVTCVVVDISKDDPEVQFSWFVDDVEVHTAQTQPREE QFNSTFRSVSELPIMEIQDWLNGKEFKCRVNSAAFPAPIEKTI SKTKGRPKAPQVYTIPPPKEQMAKDKVSLTCMITDFFPEDIT VEWQWNGQPAENYKNTQPIMNTNGSYFVYSKLNVQKSNW EAGNTFTCSVLHEGLHNEIHTEKSLSHSPGK | 363 |
| SM1B511 | HC | EVKLVESGPELVKPGASVKISCKTSGYSFTGYFMNWVMQS HGKSLEWIGRINPYNGDTFYNQKFKGKATLTVDKSSSTAHM ELRSLASEDSAVYYCARSYGYAMDYWGQGTSVTVSSAKTT PPSVYPLAPGSAAQTNSMVTLGCLVKGYFPEPVTVTWNSGS LSSGVHTFPAVLESDLYTLSSSVTVPSSPRPSETVTCNVAHPA SSTKVDKKIVPRDCGCKPCICTVPEVSSVFIFPPKPKDVLTITL TPKVTCVVVDISKDDPEVQFSWFVDDVEVHTAQTQPREEQF NSTFRSVSELPIMEIQDWLNGKEFKCRVNSAAFPAPIEKTISK TKGRPKAPQVYTIPPPKEQMAKDKVSLTCMITDFFPEDITVE WQWNGQPAENYKNTQPIMNTNGSYFVYSKLNVQKSNWEA GNTFTCSVLHEGLHNEIHTEKSLSHSPGK | 364 |
| SM1B512 | HC | EVKLVESGPELVKPGASVKISCKTSGYSFTGYFMNWVMQS HGKSLEWIGRINPYNGDTFYNQKFKGKATLTVDKSSSTAHM ELRSLASEDSAVYYCARSYGYAMDYWGQGTSVTVSSAKTT PPSVYPLAPGSAAQTNSMVTLGCLVKGYFPEPVTVTWNSGS LSSGVHTFPAVLESDLYTLSSSVTVPSSPRPSETVTCNVAHPA SSTKVDKKIVPRDCGCKPCICTVPEVSSVFIFPPKPKDVLTITL TPKVTCVVVDISKDDPEVQFSWFVDDVEVHTAQTQPREEQF NSTFRSVSELPIMEIQDWLNGKEFKCRVNSAAFPAPIEKTISK TKGRPKAPQVYTIPPPKEQMAKDKVSLTCMITDFFPEDITVE WQWNGQPAENYKNTQPIMNTNGSYFVYSKLNVQKSNWEA GNTFTCSVLHEGLHNEIHTEKSLSHSPGK | 365 |

TABLE 20-continued

LukE Light Chain (LC) and Heavy Chain (HC) Amino Acid Sequences

| mAb/Fab name | Region | Sequence | SEQ ID NO: |
|---|---|---|---|
| SM1B513 | HC | EVQLQQSGPELVKPGASVKISCKASGYSFTGYFMNWVMQS HGKSLEWIGRINPYNGDTFYNQKFKAKATLTVDKSSNTAH MELRSLASEDSAVYFCARSYGYAMDYWGLGTSVTVSSAKT TPPSVYPLAPGSAAQTNSMVTLGCLVKGYFPEPVTVTWNSG SLSSGVHTFPAVLESDLYTLSSSVTVPSSPRPSETVTCNVAHP ASSTKVDKKIVPRDCGCKPCICTVPEVSSVFIFPPKPKDVLTI TLTPKVTCVVVDISKDDPEVQFSWFVDDVEVHTAQTQPREE QFNSTFRSVSELPIMHQDWLNGKEFKCRVNSAAFPAPIEKTI SKTKGRPKAPQVYTIPPPKEQMAKDKVSLTCMITDFFPEDIT VEWQWNGQPAENYKNTQPIMNTNGSYFVYSKLNVQKSNW EAGNTFTCSVLHEGLHNEIHTEKSLSHSPGK | 366 |
| SM1B514 | HC | EVQLQQSGPELVKTGASVKISCKASGYSFTGYYMEIWVKQS HGKSLEWIGYLSCYSGATSYNQKFKGKATFTVDTSSTTAYM QFNSLTSEDSAVYYCARGESYYVMDYWGQGTSVTVSSAKT TPPSVYPLAPGSAAQTNSMVTLGCLVKGYFPEPVTVTWNSG SLSSGVHTFPAVLESDLYTLSSSVTVPSSPRPSETVTCNVAHP ASSTKVDKKIVPRDCGCKPCICTVPEVSSVFIFPPKPKDVLTI TLTPKVTCVVVDISKDDPEVQFSWFVDDVEVHTAQTQPREE QFNSTFRSVSELPIMHQDWLNGKEFKCRVNSAAFPAPIEKTI SKTKGRPKAPQVYTIPPPKEQMAKDKVSLTCMITDFFPEDIT VEWQWNGQPAENYKNTQPIMNTNGSYFVYSKLNVQKSNW EAGNTFTCSVLHEGLHNEIHTEKSLSHSPGK | 367 |
| SM1B208 | HC | EVQLQQSGGGSVQPGGSRKLSCAASGFTFSSFGMHWVRQA PEKGLEWVAYISSGSSPIYYGDTVKGRFTISRDNPNNTLFLQ MTSLRSEDTAIYYCAREGIYFYDSRYFDVWGAGTTVTVSSA KTTPPSVYPLAPGSAAQTNSMVTLGCLVKGYFPEPVTVTWN SGSLSSGVHTFPAVLESDLYTLSSSVTVPSSPRPSETVTCNVA HPASSTKVDKKIVPRDCGCKPCICTVPEVSSVFIFPPKPKDVL TITLTPKVTCVVVDISKDDPEVQFSWFVDDVEVHTAQTQPR EEQFNSTFRSVSELPIMHQDWLNGKEFKCRVNSAAFPAPIEK TISKTKGRPKAPQVYTIPPPKEQMAKDKVSLTCMITDFFPEDI TVEWQWNGQPAENYKNTQPIMNTNGSYFVYSKLNVQKSN WEAGNTFTCSVLHEGLHNEIHTEKSLSHSPGK | 368 |
| SM1B209 | HC | EVQLQQSGGGSVQPGGSRKLSCAASGFTFSSFGMHWVRQA PEKGLEWVAYISSGSSPIYYGDTVKGRFTISRDNPNNTLFLQ MTSLRSEDTAIYYCAREGIYFYDSRYFDVWGAGTTVTVSSA KTTPPSVYPLAPGSAAQTNSMVTLGCLVKGYFPEPVTVTWN SGSLSSGVHTFPAVLESDLYTLSSSVTVPSSPRPSETVTCNVA HPASSTKVDKKIVPRDCGCKPCICTVPEVSSVFIFPPKPKDVL TITLTPKVTCVVVDISKDDPEVQFSWFVDDVEVHTAQTQPR EEQFNSTFRSVSELPIMHQDWLNGKEFKCRVNSAAFPAPIEK TISKTKGRPKAPQVYTIPPPKEQMAKDKVSLTCMITDFFPEDI TVEWQWNGQPAENYKNTQPIMNTNGSYFVYSKLNVQKSN WEAGNTFTCSVLHEGLHNEIHTEKSLSHSPGK | 369 |
| SM1B210 | HC | DVQLQESGPGHSMVTLGCLVGQSIQAEFQLQQSGPELVKTG ASVKISCKASGYSFTGYYMHWVKQSHGRSLEWIGYLSCYS GATSYNQKFKGKATFTVDTSSTTAYMQFNSLTSEDSAVYYC ARGESYYVMDYWGQGTSVTVSSAKTTPPSVYPLAPGSAAQ TNSMVTLGCLVKGYFPEPVTVTWNSGSLSSGVHTFPAVLES DLYTLSSSVTVPSSPRPSETVTCNVAHPASSTKVDKKIVPRD CGCKPCICTVPEVSSVFIFPPKPKDVLTITLTPKVTCVVVDISK DDPEVQFSWFVDDVEVHTAQTQPREEQFNSTFRSVSELPIM HQDWLNGKEFKCRVNSAAFPAPIEKTISKTKGRPKAPQVYTI PPPKEQMAKDKVSLTCMITDFFPEDITVEWQWNGQPAENY KNTQPIMNTNGSYFVYSKLNVQKSNMTEAGNTFTCSVLHEG LHNEIHTEKSLSHSPGK | 370 |
| SM1B211 | HC | EVQLQQSGPGLVKPSQTVSLTCTVTGYSITNGNHWWNWIR QVSGSKLEWIGYISSSGSTDSNPSLKSRISITRDTSKNQLFLQL NSVTTEDIATYYCARGHYYDGSSYAMDYWGQGTSVTVSSA KTTAPSVYPLAPVCGDTSDSMVTLGCLVKGYFPEPVTVTW NSGSLSSGVHTFPAVLESDLYTLSSSVTVPSSPRPSETVTCNV AHPASSTKVDKKIVPRDCGCKPCICTVPEVSSVFIFPPKPKDV LTITLTPKVTCVVVDISKDDPEVQFSWFVDDVEVHTAQTQP REEQFNSTFRSVSELPIMHQDWLNGKEFKCRVNSAAFPAPIE KTISKTKGRPKAPQVYTIPPPKEQMAKDKVSLTCMITDFFPE DITVEWQWNGQPAENYKNTQPIMNTNGSYFVYSKLNVQKS NWEAGNTFTCSVLEIEGLHNEIHTEKSLSHSPGK | 371 |

TABLE 21

LukD Light Chain (LC) and Heavy Chain (HC) Amino Acid Sequences

| mAb/Fab name | Region | Sequence | SEQ ID NO: |
|---|---|---|---|
| SM1B221 | LC | QIVLTQSPAIMSASPGEKVTITCSASLSVSYMHWFQQKPGTS PKLWIYSASNLASGVPARFSGSGSGTSYSLTISRMEAEDAAT YYCQQRSSYPFTFGSGTKLEIKRADAAPTVSIFPPSSEQLTSG GASVVCFLNNFYPKDINVKWKIDGSERQNGVLNSWTDQDS KDSTYSMSSTLTLTKDEYERHNSYTCEATHKTSTSPIVKSFN RNEC | 414 |
| SM1B 222 | LC | DVVMTQTPLSLPVSLGDQASISCRSSQSLIHNDGNTYLHWY LQKPGQSPKLLIYKVSNRFSGVPDRFSGSGSGTDFTVKISRV EAEDLGVYFCSQSTHVPFTFGAGTKLELKRADAAPTVSIFPP SSEQLTSGGASVVCFLNNFYPKDINVKWKIDGSERQNGVLN SWTDQDSKDSTYSMSSTLTLTKDEYERHNSYTCEATEIKTST SPIVKSFNRNEC | 415 |
| SM1B223 | LC | QIVLSQSPAIMSASPGEKVTITCSASLSVSFMHWFQQKPGTSP KLWIYSASNLASGVPARFSGSGSGTSYSLTISRMEAEDAATY YCQQRSSYPFTFGSGTKLEIKRADAAPTVSIFPPSSEQLTSGG ASVVCFLNNFYPKDINVKWKIDGSERQNGVLNSWTDQDSK DSTYSMSSTLTLTKDEYERHNSYTCEATHKTSTSPIVKSFNR NEC | 416 |
| SM1B224 | LC | QIVLTQSPAIMSASPGEKVTITCSASSSVSFMEIWFQQKPGTSP KLWIYSTSNLASGVPARFSGSGSGTSYSLTISRMEAEDAATY YCQQRSTYPYTFGGGTKMEIKRADAAPTVSIFPPSSEQLTSG GASVVCFLNNFYPKDINVKWKIDGSERQNGVLNSWTDQDS KDSTYSMSSTLTLTKDEYERHNSYTCEATHKTSTSPIVKSFN RNEC | 417 |
| 5M1B225 | LC | DIVLTQSPAIMSASLGERVTMTCTASSSVSSSYLHWYQQKP GSSPKLWVYSTSNLASGVPARFSGSGSGSSYSLTISSMEPED TATYYCHQYHRSPQTFGGGTKLEIKRADAAPTVSIFPPSSEQ LTSGGASVVCFLNNFYPKDINVKWKIDGSERQNGVLNSWT DQDSKDSTYSMSSTLTLTKDEYERHNSYTCEATHKTSTSPIV KSFNRNEC | 418 |
| SM1B226 | LC | QIVLTQSPAIMSASPGEKVTITCSASSSVSFMEIWFQQKPGTSP KLWIYSASNLASGVPARFSGSGSGTSYSLTISRMEAEDAATY YCQQRSSYPYTFGGGTKLEIKRADAAPTVSIFPPSSEQLTSGG ASVVCFLNNFYPKDINVKWKIDGSERQNGVLNSWTDQDSK DSTYSMSSTLTLTKDEYERHNSYTCEATHKTSTSPIVKSFNR NEC | 419 |
| SM1B227 | LC | DIVLTQSPAIMSASPGEKVTMTCSASSSVSYMEIWYQQKSST SPKLWIYDTSKLASGVPGRFSGSGSGNSYSLTISSMEAEDVA TYYCFQGSGYPLTFGSGTKLEIKRADAAPTVSIFPPSSEQLTS GGASVVCFLNNFYPKDINVKWKIDGSERQNGVLNSWTDQD SKDSTYSMSSTLTLTKDEYERHNSYTCEATHKTSTSPIVKSF NRNEC | 420 |
| SM1B228 | LC | QIVLTQSPAIMSASPGEKVTITCSASSSVSYMHWFQQKPGTS PKLWIYSASNLASGVPARFSGSGSGTSYSLTISRMEAEDAAT YYCQQRSSYPFTFGSGTKLEIKRADAAPTVSIFPPSSEQLTSG GASVVCFLNNFYPKDINVKWKIDGSERQNGVLNSWTDQDS KDSTYSMSSTLTLTKDEYERHNSYTCEATHKTSTSPIVKSFN RNEC | 421 |
| SM1B221 | HC | QVQLQQSGAELVMPGASVKMSCKASGYTFTDYWMEIWVK QRPGQGLEWIGAIDTSDSYTSYNQKFKGKATLTVDESSSTA YMQLSSLTSEDSAVYYCARDYGYAMDYWGQGTSVTVSSA KTTPPSVYPLAPGSAAQTNSMVTLGCLVKGYFPEPVTVTWN SGSLSSGVHTFPAVLESDLYTLSSSVTVPSSPRPSETVTCNVA HPASSTKVDKKIVPRDCGCKPCICTVPEVSSVFIFPPKPKDVL TITLTPKVTCVVVDISKDDPEVQFSWFVDDVEVHTAQTQPR EEQFNSTFRSVSELPIMHQDWLNGKEFKCRVNSAAFPAPIEK TISKTKGRPKAPQVYTIPPPKEQMAKDKVSLTCMITDFFPEDI TVEWQWNGQPAENYKNTQPIMNTNGSYFVYSKLNVQKSN WEAGNTFTCSVLHEGLHNEIHTEKSLSHSPGK | 422 |
| SM1B222 | HC | EVQLQQSGAMLARPGASVTMSCKASGYTFTDYWMEIWVR QGPGQGLEWIGAIFPGNSDTTYNQKFRGKAKLTAVTSAITA YMEVSSLTNIDSAVYYCTVTELDYWGQGTTLTVSSAKTTPP SVYPLAPGSAAQTNSMVTLGCLVKGYFPEPVTVTWNSGSLS SGVHTFPAVLESDLYTLSSSVTVPSSPRPSETVTCNVAHPASS TKVDKKIVPRDCGCKPCICTVPEVSSVFIFPPKPKDVLTITLTP | 423 |

TABLE 21-continued

LukD Light Chain (LC) and Heavy Chain (HC) Amino Acid Sequences

| mAb/Fab name | Region | Sequence | SEQ ID NO: |
|---|---|---|---|
| | | KVTCVVVDISKDDPEVQFSWFVDDVEVHTAQTQPREEQFNS TFRSVSELPIMHQDWLNGKEFKCRVNSAAFPAPIEKTISKTK GRPKAPQVYTIPPPKEQMAKDKVSLTCMITDFFPEDITVEWQ WNGQPAENYKNTQPIMNTNGSYFVYSKLNVQKSNMTEAGN TFTCSVLHEGLHNEIHTEKSLSHSPGK | |
| SM1B223 | HC | EVQLQQSGADLVMPGTSMKLSCKASGYTFTDYWIHWVKQ GPGQGLEWIGAIDTSDSYINYNQKFTDKATLTVDESSSTAY MEILSSLTSEDSAVYYCARDYGYAMDYWGQGTSVTVSSAK TTPPSVYPLAPGSAAQTNSMVTLGCLVKGYFPEPVTVTWNS GSLSSGVHTFPAVLESDLYTLSSSVTVPSSPRPSETVTCNVAH PASSTKVDKKIVPRDCGCKPCICTVPEVSSVFIFPPKPKDVLTI TLTPKVTCVVVDISKDDPEVQFSWFVDDVEVHTAQTQPREE QFNSTFRSVSELPIMHQDWLNGKEFKCRVNSAAFPAPIEKTI SKTKGRPKAPQVYTIPPPKEQMAKDKVSLTCMITDFFPEDIT VEWQWNGQPAENYKNTQPIMNTNGSYFVYSKLNVQKSNW EAGNTFTCSVLHEGLHNEIHTEKSLSHSPGK | 424 |
| SM1B224 | HC | QVQLQQPGAELVMPGSSVKMSCKASGYTFTDYWMEIWVK QRPGQGLEWIGAIDASDSYTSYDQKFKGKATLTVDDSSSTA YIHLNSLTSEDSAVYYCARDFGYAMDYWGQGTSVTVSSAK TTPPSVYPLAPGSAAQTNSMVTLGCLVKGYFPEPVTVTWNS GSLSSGVHTFPAVLESDLYTLSSSVTVPSSPRPSETVTCNVAH PASSTKVDKKIVPRDCGCKPCICTVPEVSSVFIFPPKPKDVLTI TLTPKVTCVVVDISKDDPEVQFSWFVDDVEVHTAQTQPREE QFNSTFRSVSELPIMHQDWLNGKEFKCRVNSAAFPAPIEKTI SKTKGRPKAPQVYTIPPPKEQMAKDKVSLTCMITDFFPEDIT VEWQWNGQPAENYKNTQPIMNTNGSYFVYSKLNVQKSNW EAGNTFTCSVLHEGLHNEIHTEKSLSHSPGK | 425 |
| SM1B225 | HC | EVQLQQSGGGLVKPGGSLKLSCAASGFTFSSYAMSWVRQT PEKRLEWVATITGGGTYTYYLDSVKGRFTISRDNAKTSLYL QMSSLRSEDTAMYYCAREIRDGNYGCFDVWGAGTTVTVSS AKTTPPSVYPLAPGSAAQTNPMVTLGCLVKGYFPEPVTVTW NSGSLSSGVHTFPAVLESDLYTLSSSVTVPSSPRPSETVTCNV AHPASSTKVDKKIVPRDCGCKPCICTVPEVSSVFIFPPKPKDV LTITLTPKVTCVVVDISKDDPEVQFSWFVDDVEVHTAQTQP REEQFNSTFRSVSELPIMHQDWLNGKEFKCRVNSAAFPAPIE KTISKTKGRPKAPQVYTIPPPKEQMAKDKVSLTCMITDFFPE DITVEWQWNGQPAENYKNTQPIMNTNGSYFVYSKLNVQKS NWEAGNTFTCSVLEIEGLHNEIHTEKSLSHSPGK | 426 |
| SM1B226 | HC | EVQLQQSGAELVMPGASVKMSCKASGYTFTDYWMEIWVL QRPGQGLEWIGAIDTSDSYTTYNQKFKGKATLTVDESSSTA YMLLSSLTSEDSAVYYCARDYGYAMDYWGQGSSVTVSSA KTTPPSVYPLAPGSAAQTNSMVTLGCLVKGYFPEPVTVTWN SGSLSSGVHTFPAVLESDLYTLSSSVTVPSSPRPSETVTCNVA HPASSTKVDKKIVPRDCGCKPCICTVPEVSSVFIFPPKPKDVL TITLTPKVTCVVVDISKDDPEVQFSWFVDDVEVHTAQTQPR EEQFNSTFRSVSELPIMEIQDWLNGKEFKCRVNSAAFPAPIEK TISKTKGRPKAPQVYTIPPPKEQMAKDKVSLTCMITDFFPEDI TVEWQWNGQPAENYKNTQPIMNTNGSYFVYSKLNVQKSN WEAGNTFTCSVLHEGLHNEIHTEKSLSHSPGK | 427 |
| SM1B227 | HC | EFQLQQSGPELVKPGASVKMSCKASGYTFTSYFIHWVKQKP GQGLEWIGFINPYNADTNYNEKFKGKATLTSDKSSSTAYME LSSLTSEDSAVYYCTPSAMDYWGQGTSVTVSSAKTTPPSVY PLAPGSAAQTNSMVTLGCLVKGYFPEPVTVTWNSGSLSSGV HTFPAVLESDLYTLSSSVTVPSSPRPSETVTCNVAHPASSTKV DKKIVPRDCGCKPCICTVPEVSSVFIFPPKPKDVLTITLTPKVT CVVVDISKDDPEVQFSWFVDDVEVHTAQTQPREEQFNSTFR SVSELPIMEIQDWLNGKEFKCRVNSAAFPAPIEKTISKTKGRP KAPQVYTIPPPKEQMAKDKVSLTCMITDFFPEDITVEWQWN GQPAENYKNTQPIMNTNGSYFVYSKLNVQKSNWEAGNTFT CSVLEIEGLHNEIHTEKSLSHSPGK | 428 |
| SM1B228 | HC | QVQLQQSGAELVMPGASVKMSCKASGYTFTDYWMEIWVK QRPGQGLEWIGAIDTSDSYTTYNQKFKGKATLTVDESSSTA YMQLSSLTSEDSAVYYCARDYGYAMDYWGQGTSVTVSSA KTTPPSVYPLAPGSAAQTNSMVTLGCLVKGYFPEPVTVTWN SGSLSSGVHTFPAVLESDLYTLSSSVTVPSSPRPSETVTCNVA HPASSTKVDKKIVPRDCGCKPCICTVPEVSSVFIFPPKPKDVL TITLTPKVTCVVVDISKDDPEVQFSWFVDDVEVHTAQTQPR EEQFNSTFRSVSELPIMEIQDWLNGKEFKCRVNSAAFPAPIEK | 429 |

TABLE 21-continued

LukD Light Chain (LC) and Heavy Chain (HC) Amino Acid Sequences

| mAb/Fab name | Region | Sequence | SEQ ID NO: |
|---|---|---|---|
| | | TISKTKGRPKAPQVYTIPPPKEQMAKDKVSLTCMITDFFPEDI TVEWQWNGQPAENYKNTQPIMNTNGSYFVYSKLNVQKSN WEAGNTFTCSVLHEGLHNEIHTEKSLSHSPGK | |

TABLE 22

HlgA Light Chain (LC) and Heavy Chain (HC) Amino Acid Sequences

| mAb/Fab name | Region | Sequence | SEQ ID NO: |
|---|---|---|---|
| SM1B215 | LC | DVVMTQTPLTLS\TIGQPASISCKSSQSLLDSDGKTYLNWLL QRPGQSPKRLIYVVSKLDSGVPDRFTGSGSGTDFTLKISRVE AEDLGVYYCWQGTHFPLTFGAGTKLELKRADAAPTVSIFPP SSEQLTSGGASWCFLNNFYPKDINVKWKIDGSERQNGVLN SWTDQDSKDSTYSMSSTLTLTKDEYERHNSYTCEATHKTST SPIVKSFNRNEC | 458 |
| SM1B216 | LC | DVVMTQTPSSFSVSLGDGVTITCKASEDIYIRLAWYQQKPG NAPRLLIFGATSLETGVPSRFSGSGSGKDYTLSITSLQTEDVA TYYCQQYWRTPLTFGAGTKLELKRADAAPTVSIFPPSSEQLT SGGASVVCFLNNFYPKD1NVKWKIDGSERQNGVLNSWTDQ DSKDSTYSMSSTLTLTKDEYERHNSYTCEATHKTSTSPIVKS FNRNEC | 459 |
| SM1B217 | LC | DWMTQTPLTLSVTIGQPASISCKSSQSLLDSDGKTYLNWLL QRPGQSPKRLIYLVSKLDSGVPDRFTGSGSGTDFTLKISRVE AEDLGVYYCWQGTHFPLTFGAGTKLELKRADAAPTVSIFPP SSEQLTSGGASVVCFLNNFYPKDINVKWKIDGSERQNGVLN SWTDQDSKDSTYSMSSTLTLTKDEYERHNSYTCEATHKTST SPIVKSFNRNEC | 460 |
| SM1B218 | LC | DVVMTQTPLTLSVTIGQPASISCKSSQSLLDSDGKTYLNWLL QRPGQSPKRLIYLVSKLDSGVPDRFTGSGSGTDFTLKISRVE AEDLGVYYCWQGTHFPLTFGAGTKLELKRADAAPTVSIFPP SSEQLTSGGASWCFLNNFYPKDINVKAVKIDGSERQNGVLN SWTDQDSKDSTYSMSSTLTLTKDEYERHNSYTCEATHKTST SPIVKSFNRNEC | 461 |
| SM1B219 | LC | DVVMTQTPLTLSVTIGQPASISCKSSQSLLDSDGKTYLNWLL QRPGQSPKRLIYVVSKLDSGVPDRFTGSGSGTDFTLKISRVE AEDLGVYYCWQGTHFPLTFGAGTKLELKRADAAPTVSIFPP SSEQLTSGGASWCFLNNFYPKDINVKWKIDGSERQNGVLN SWTDQDSKDSTYSMSSTLTLTKDEYERHNSYTCEATHKTST SPIVKSFNRNEC | 462 |
| SM1B220 | LC | DVVMTQTPLTLSVTIGQPASISCKSSQSLLDSDGKTYLNWLL QRPGQSPKRLIYVVSKLDSGVPDRFTGSGSGTDFTLKISRVE AEDLGVYYCWQGTHFPLTFGAGTKLELKRADAAPTVSIFPP SSEQLTSGGASVVCFLNNFYPKDINVKWKIDGSERQNGVLN SWTDQDSKDSTYSMSSTLTLTKDEYERHNSYTCEATHKTST SPIVKSFNRNEC | 463 |
| SMIB215 | HC | EVQLQQSGPELKKPGETVKISCKTSGYTFTIYGMNWMKQAP GKGLKVVMGWINTYTGEPTYADDFKGRFAFSLETSASTAYL QINNLKNEDTATYFCARCYYKYEDYAMDYWGQGTSVTVS SAKTTPPSVYPLAPGSAAQTNSMVTLGCLVKGYFPEPVTVT WNSGSLSSGVHTFPAVLESDLYTLSSSVTVPSSPRPSETVTC NVAHPASSTKVDKKIVPRDCGCKPCICTVPEVSSVFIFPPKPK DVLTITLTPKVTCVVVDISKDDPEVQFSWFVDDVEVHTAQT QPREEQFNSTFRSVSELPIMHQDWLNGKEFKCRVNSAAFPA PIEKTISKTKGRPKAPQVYTIPPPKEQMAKDKVSLTCMITDFF PEDITVEWQWNGQPAENYKNTQPIMNTNGSYFVYSKLNVQ KSNWEAGNTFTCSVLHEGLHNHHTEKSLSHSPGK | 464 |
| SM1B216 | HC | EVKLVESGGGLVKPGGSLKLSCAASGFTFSSYAMSWVRQTP EKRLEWVAAINGNGGSTYYPDTVKDRFTISRDNAKNTLYLQ MSSLRSEDTALYYCARHRADGPWFTYWGQGTLVTVSAAK TTPPSVYPLAPGSAAQTNPMVTLGCLVKGYFPEPVTVTWNS GSLSSGVHTFPAVLESDLYTLSSSVTVPSSPRPSETVTCNVAH | 465 |

TABLE 22-continued

HlgA Light Chain(LC) and Heavy Chain (HC) Amino Acid Sequences

| mAb/Fab name | Region | Sequence | SEQ ID NO: |
|---|---|---|---|
| | | PASSTKVDKKIVPRDCGCKPCICTVPEVSSVFIFPPKPKDVLTI TLTPKVTCWVDISKDDPEVQFSWFVDDVEVHTAQTQPREE QFNSTFRSVSELPIMHQDWLNGKEFKCRVNSAAFPAPIEKTI SKTKGRPKAPQVYTIPPPKEQMAKDKVSLTCMITDFFPEDIT VEWQWNGQPAENYKNTQPIMNTNGSYFVYSKLNVQKSNW EAGNTFTCSVLHEGLHNHHTEKSLSHSPGK | |
| SM1B217 | HC | EVKLVESGGGLVKPGGSLK.LSCAASGFTFSNYAMSWVRQI PEKRLEWVASISRRGSTYYPDSVKGRFTISRDNARNILYLQM SSLRSEDTALYYCATVYYDNPWFVYWGQGTLVTVSAAKTT PPSVYPLAPGSAAQTNSMVTLGCLVKGYFPEPVTVTWNSGS LSSGVHTFPAVLESDLYTLSSSVTVPSSPRPSETVTCNVAHPA SSTKVDKKIVPRDCGCKPCICTVPEVSSVFIFPPKPKDVLTITL TPKVTCVWDISKDDPEVQFSWFVDDVEVHTAQTQPREEQF NSTFRSVSELPIMHQDWLNGKEFKCRVNSAAFPAPIEKTISK TKGRPKAPQVYTIPPPKEQMAKDKVSLTCMITDFFPEDITVE WQWNGQPAENYKNTQPIMNTNGSYFVYSKLNVQKSNWEA GNTFRCSVLHEGLHNHHTEKSLSHSPGK | 466 |
| SM1B218 | HC | QIQLVQSGPELKKPGETVKISCKTSGYTFTIYGMNWTKQAP GKGLKWMGWINTYTGEPTYADDFKGRFAFSLETSASTAYL QINNLKNEDTATYFCARCYYKYEDYAMDYWGQGTSVTVS SAKTTPPSVYPLAPGSAAQTNSMVTLGCLVKGYFPEPVTVT WNSGSLSSGVHTFPAVLESDLYTLSSSVTVPSSPRPSETVTC NVAHPASSTKVDKKIVPRDCGCKPCICTVPEVSSVFIFPPKPK DVLTITLTPKVTCVWDISKDDPEVQFSWFVDDVEVHTAQT QPREEQFNSTFRSVSELPIMHQDWLNGKEFKCRVNSAAFPA PIEKTISKTKGRPKAPQVYTIPPPKEQMAKDKVSLTCMITDFF PEDITVEWQWNGQPAENYKNTQPIMNTNGSYFVYSKLNVQ KSNWEAGNTFTCSVLHEGLHNHHTEKSLSHSPGK | 467 |
| SMIB219 | HC | DVKLVESGGGLVKPGGSLKLSCAASGFTFSSYAMSWVRQT PEKRLEWAAINGNGGSTYYPDTVKDRFTISRDNAKNTLYL QMSSLRSEDTALYYCARHRADGPWFTYWGQGTLVTVSAA KTTPPSVYPLAPGSAAQTNSNWTLGCLVKGYFPEPVTVTWN SGSLSSGVHTFPAVLESDLYTLSSSVTVPSSPRPSETVTCNVA HPASSTKVDKKIVPRDCGCKPCICTVPEVSSVFIFPPKPKDVL TITLTPKVTCVVVDISKDDPEVQFSWFVDDVEVHTAQTQPR EEQFNSTFRSVSELPIMHQDWLNGKEFKCRVNSAAFPAPIEK TISKTKGRPKAPQVYTIPPPKEQMAKDKVSLTCMITDFFPEDI TVEWQWNGQPAENYKNTQPIMNTNGSYFVYSKLNVQKSN WEAGNTFTCSVLHEGLHNHHTEKSLSHSPGK | 468 |
| SM1B220 | HC | EVKLVESGGGLVKPGGSLKLSCAASGFTFSNYAMSWVRQI PEKRLEWVASISRRGSTYYPDSVKGRFTISRDNARNILYLQM SSLRSEDTALYYCATVYYDNPWFVYWGQGTLVTVSAAKTT PPSVYPLAPGSAAQTNSMVTLGCLVKGYFPEPVTVTWNSGS LSSGVHTFPAVLESDLYTLSSSVTVPSSPRPSETVTCNVAHPA SSTKVDKKIVPRDCGCKPCICTVPEVSSVFIFPPKPKDVLTITL TPKVTCVVVDISKDDPEVQFSWFVDDVEVHTAQTQPREEQF NSTFRSVSELPIMHQDWLNGKEFKCRVNSAAFPAPIEKTISK TKGRPKAPQVYTIPPPKEQMAKDKVSLTCMITDFFPEDITVE WQWNGQPAENYKNTQPIMNTNGSYFVYSKLNVQKSNWEA GNTFTCSVLHEGLHNHHTEKSLSHSPGK | 469 |

TABLE 23

HlgC Light Chain(LC) and Heavy Chain (HC) Amino Acid Sequences

| mAb/Fab name | Region | Sequence | SEQ ID NO: |
|---|---|---|---|
| SM1B202 | LC | ETTVTQSPASLSVATGEKVTIRCITSTDIDDDMSWYQQKPGE PPKLLISEGNTLRPGVPSRFSSSGCGTDFVFTIENTLSEDVAD YYCLQSDNMPYTFGGGTKLEIKRADAAPTVSIFPPSSEQLTS GGASVVCFLNNFYPKDINVKWKIDGSERQNGVLNSWTDQD SKDSTYSMSSTLTLTKDEYERHNSYTCEATEIKTSTSPIVKSF NRNEC | 500 |

TABLE 23-continued

HlgC Light Chain(LC) and Heavy Chain (HC) Amino Acid Sequences

| mAb/Fab name | Region | Sequence | SEQ ID NO: |
|---|---|---|---|
| SM1B203 | LC | DIVMTQSPATLSVTPGDRVSLSCRASQSISDYLHWYQQKSH ESPRLLIKYDSQSISGIPSRFSGSGSGSDFTLSINSVEPEDVGV YYCQNGEIRFPFTFGGGTKLEIKRADAAPTVSIFPPSSEQLTSG GASVVCFLNNFYPKDINVKWKIDGSERQNGVLNSWTDQDS KDSTYSMSSTLTLTKDEYERHNSYTCEATHKTSTSPIVKSFN RNEC | 501 |
| SM1B204 | LC | NIMMTQSPSSLTVSAGEKVTMSCKSSQSVLYSSNQKNYLA WYQQKPGQSPKLLIYWASTRESGVPDRFAGSGSGTDFTLSIS SVQAEDLAVYYCHQYLSSYTFGGGTKLEIKRADAAPTVSIFP PSSEQLTSGGASVVCFLNNFYPKDINVKWKIDGSERQNGVL NSWTDQDSKDSTYSMSSTLTLTKDEYERHNSYTCEATEIKTS TSPIVKSFNRNEC | 502 |
| SM1B205 | LC | DIVLTQSPASLAVSLGQRATISYRASKSVSTSGYSYMHWNQ QKPGQPPRLLIYLVSNLESGVPARFSGSGSGTDFTLNIHPVEE EDAATYYCQHIRELTRSEGGTKLEIKRADAAPTVSIFPPSSEQ LTSGGASVVCFLNNFYPKDINVKWKIDGSERQNGVLNSWT DQDSKDSTYSMSSTLTLTKDEYERHNSYTCEATEIKTSTSPIV KSFNRNEC | 503 |
| SM1B206 | LC | DIVMTQSPATLSVTPGDRVSLSCRASQSISDYLHWYQQKSH ESPRLLIKYASQSISGIPSRFSGSGSGSDFTLSINSVEPEDVGV YYCQNGHSFPLTFGAGTKLELKRADAAPTVSIFPPSSEQLTS GGASVVCFLNNFYPKDINVKWKIDGSERQNGVLNSWTDQD SKDSTYSMSSTLTLTKDEYERHNSYTCEATEIKTSTSPIVKSF NREC | 504 |
| SM1B207 | LC | DIVLTQSPASLAVSLGQRATISCQASESVSFAGTSLMHWYQ QKPGQSPKLLIYWASTRESGVPDRFAGSGSGTDFTLSISSVQ AEDLAVYYCHQYLSSYTFGGGTKLEIKRADAAPTVSIFPPSS EQLTSGGASVVCFLNNFYPKDINVKWKIDGSERQNGVLNS WTDQDSKDSTYSMSSTLTLTKDEYERHNSYTCEATEIKTSTS PIVKSFNRNEC | 505 |
| SM1B202 | HC | EVMLVESGGGLVKPGGSLKLSCAASGFTFSNYAMSWVRQT PEKRLEWVASISRRGSTYYPDSGKGRFTISRDNARNIPYLQM SSLRSEDTALYYCATVYYDNPWFVYWGQGTLVTVSAAKTT APSVYPLAPVCGDTTGSSVTLGCLVKGYFPEPVTLTWNSGS LSSGVHTFPAVLQSDLYTLSSSVTVTSSTWPSQSITCNVAHP ASSTKVDKKIEPRGPTIKPCPPCKCPAPNLLGGPSVFIFPPKIK DVLMISLSPIVTCVVVDVSEDDPDVQISWFVNNVEVHTAQT QTHREDYNSTLRVVSALPIQHQDWMSGKEFKCKVNNKDLP APIERTISKPKGSVRAPQVYVLPPPEEEMTKKQVTLTCMVTD FMPEDIYVEWTNNGKTELNYKNTEPVLDSDGSYFMYSKLR VEKKNWVERNSYSCSVVEIEGLHNEIHTTKSFSRTPGK | 506 |
| SM1B203 | HC | EVMLVESGGGLVKPGGSLKLSCAASGFTFSNYAMSWVRQT PEKRLEWVASISRRGSTYYPDSVKGRFTISRDNARNILYLQM SSLRSEDTALYYCATVYYDNPWFVYWGQGTLVTVSAAKTT APSVYPLAPVCGDTTGSSVTLGCLVKGYFPEPVTLTWNSGS LSSGVHTFPAVLQSDLYTLSSSVTVTSSTWPSQSITCNVAHP ASSTKVDKKIEPRGPTIKPCPPCKCPAPNLLGGPSVFIFPPKIK DVLMISLSPIVTCVVVDVSEDDPDVQISWFVNNVEVHTAQT QTHREDYNSTLRVVSALPIQHQDWMSGKEFKCKVNNKDLP APIERTISKPKGSVRAPQVYVLPPPEEEMTKKQVTLTCMVTD FMPEDIYVEWTNNGKTELNYKNTEPVLDSDGSYFMYSKLR VEKKNWVERNSYSCSVVEIEGLHNEIHTTKSFSRTPGK | 507 |
| SM1B204 | HC | EVKLVESGGGLVKPGGSLKLSCAASGFTFSNYAMSWVRQT PEKRLEWVASISRRGSTYYPDSVKGRFTISRDNARNILYLQM SSLRSEDTALYYCATVYYDNPWFVYWGQGTLVTVSAAKTT APSVYPLAPVCGDTTGSSVTLGCLVKGYFPEPVTLTWNSGS LSSGVHTFPAVLQSDLYTLSSSVTVTSSTWPSQSITCNVAHP ASSTKVDKKIEPRGPTIKPCPPCKCPAPNLLGGPSVFIFPPKIK DVLMISLSPIVTCVVVDVSEDDPDVQISWFVNNVEVHTAQT QTHREDYNSTLRVVSALPIQHQDWMSGKEFKCKVNNKDLP APIERTISKPKGSVRAPQVYVLPPPEEEMTKKQVTLTCMVTD FMPEDIYVEWTNNGKTELNYKNTEPVLDSDGSYFMYSKLR VEKKNWVERNSYSCSVVEIEGLHNEIHTTKSFSRTPGK | 508 |
| SM1B205 | HC | EVKLVESGGGLVKPGGSLKLSCAASGFTFSNYAMSWVRQT PEKRLEWVASISRRGSTYYPDSVKGRFTISRDNARNILYLQM | 509 |

TABLE 23-continued

HlgC Light Chain(LC) and Heavy Chain (HC) Amino Acid Sequences

| mAb/Fab name | Region | Sequence | SEQ ID NO: |
|---|---|---|---|
| | | SSLRSEDTALYYCATVYYDNPWFVYWGQGTLVTVSAAKTT APSVYPLAPVCGDTTGSSVTLGCLVKGYFPEPVTLTWNSGS LSSGVHTFPAVLQSDLYTLSSSVTVTSSTWPSQSITCNVAHP ASSTKVDKKIEPRGPTIKPCPPCKCPAPNLLGGPSVFIFPPKIK DVLMISLSPIVTCVVVDVSEDDPDVQISWFVNNVEVHTAQT QTHREDYNSTLRVVSALPIQHQDWMSGKEFKCKVNNKDLP APIERTISKPKGSVRAPQVYVLPPPEEEMTKKQVTLTCMVTD FMPEDIYVEWTNNGKTELNYKNTEPVLDSDGSYFMYSKLR VEKKNWVERNSYSCSVVEIEGLHNEIHTTKSFSRTPGK | |
| 5M1B206 | HC | EVKLVESGGGLVKPGGSLKLSCAASGFTFSNYAMSWVRQT PEKRLEWVASISRRGSTYYPDSVKGRFTISRDNARNILYLQM SSLRSEDTALYYCATVYYDNPWFVYWGQGTLVTVSAAKTT APSVYPLAPVCGDTTGSSVTLGCLVKGYFPEPVTLTWNSGS LSSGVHTFPAVLQSDLYTLSSSVTVTSSTWPSQSITCNVAHP ASSTKVDKKIEPRGPTIKPCPPCKCPAPNLLGGPSVFIFPPKIK DVLMISLSPIVTCVVVDVSEDDPDVQISWFVNNVEVHTAQT QTHREDYNSTLRVVSALPIQHQDWMSGKEFKCKVNNKDLP APIERTISKPKGSVRAPQVYVLPPPEEEMTKKQVTLTCMVTD FMPEDIYVEWTNNGKTELNYKNTEPVLDSDGSYFMYSKLR VEKKNWVERNSYSCSVVEIEGLHNEIHTTKSFSRTPGK | 510 |
| SM1B207 | HC | EVMLVESGGGLVKPGGSLKLSCAASGFTFSNYAMSWVRQT PEKRLEWVASISRRGSTYYPDSVKGRFTISRDNARNILYLQM SSLRSEDTALYYCATVYYDNPWFVYWGQGTLVTVSAAKTT APSVYPLAPVCGDTTGSSVTLGCLVKGYFPEPVTLTWNSGS LSSGVHTFPAVLQSDLYTLSSSVTVTSSTWPSQSITCNVAHP ASSTKVDKKIEPRGPTIKPCPPCKCPAPNLLGGPSVFIFPPKIK DVLMISLSPIVTCVVVDVSEDDPDVQISWFVNNVEVHTAQT QTHREDYNSTLRVVSALPIQHQDWMSGKEFKCKVNNKDLP APIERTISKPKGSVRAPQVYVLPPPEEEMTKKQVTLTCMVTD FMPEDIYVEWTNNGKTELNYKNTEPVLDSDGSYFMYSKLR VEKKNWVERNSYSCSVVEIEGLHNEIHTTKSFSRTPGK | 511 |

TABLE 24

LukE/HlgA Light Chain (LC) and Heavy Chain (HC) Amino Acid Sequences

| mAb/Fab name | region | sequence | SEQ ID NO: |
|---|---|---|---|
| SM1B302 | LC | DIQMTQSPSSLSASLGERVSLTCRASQDIGSSLNWLQQEPDG TIKRLIYATSSLDSGVPKRFSGSRSGSDYSLTISSLESEDFVDY YCLQYASSPWTFGGGTKLEIKRADAAPTVSIFPPSSEQLTSG GASVVCFLNNFYPKDINVKWKIDGSERQNGVLNSWTDQDS KDSTYSMSSTLTLTKDEYERHNSYTCEATEIKTSTSPIVKSFN RNEC | 733 |
| 5M1B303 | LC | DIQMTQTTSSLSASLGDRVTISCWASQDIRSYLNWYQQKPD GTVKLLIYYTSRLHSGVPSRFSGSGSGTDFSLTISNLEQEDIA TYFCQQGNTLPYTFGGGTKLEIKRADAAPTVSIFPPSSEQLTS GGASVVCFLNNFYPKDINVKWKIDGSERQNGVLNSWTDQD SKDSTYSMSSTLTLTKDEYERHNSYTCEATEIKTSTSPIVKSF NRNEC | 734 |
| SM1B304 | LC | DIQMTQSPSSLSASLGERVSLTCRASQEISGYLSWLQQKPDG TIKRLIYAASTLDSGVPKRFSGSRSGSDYSLTISSLESEDFAD YYCLQYASYPRTFGGGTKLEIKRADAAPTVSIFPPSSEQLTS GGASVVCFLNNFYPKDINVKWKIDGSERQNGVLNSWTDQD SKDSTYSMSSTLTLTKDEYERHNSYTCEATEIKTSTSPIVKSF NRNEC | 735 |
| SM1B305 | LC | DVLMTQTPLSLPVSLGDQASISCRSSQIIVHSNGNTYLDWYL QKPGQSPKLLIYKISNRFSGVPDRFSGSGSGTDFTLKISRVEA EDLGVYYCFQGSHVPWTFGGGTKLEIKRADAAPTVSIFPPSS EQLTSGGASVVCFLNNFYPKDINVKWKIDGSERQNGVLNS WTDQDSKDSTYSMSSTLTLTKDEYERHNSYTCEATEIKTSTS PIVKSFNRNEC | 736 |

TABLE 24-continued

LukE/HlgA Light Chain (LC) and Heavy Chain (HC) Amino Acid Sequences

| mAb/Fab name | region | sequence | SEQ ID NO: |
|---|---|---|---|
| SM1B306 | LC | DVVVTQTPLSLPVSFGDQVSISCRSSQSLANSYGNTYLSWYL HKPGQSPQLLIYGISNRFSGVPDRFSGSGSGTDFTLKISTIKPE GLGMYYCLQGTHQPPTFGAGTKLELKRADAAPTVSIFPPSSE QLTSGGASVVCFLNNFYPKDINVKWKIDGSERQNGVLNSW TDQDSKDSTYSMSSTLTLTKDEYERHNSYTCEATEIKTSTSPI VKSFNRNEC | 737 |
| SM1B307 | LC | DIVLTQSPASLAVSLGQRATISCRASESVDSYGNSFMEIWYQ QKPGQPPKLLIYRASNLESGIPARFSGSGSRTDFTLTINPVEA DDVATYYCQQSNEDPPWTFGGGTKLEIKRADAAPTVSIFPPS SEQLTSGGASVVCFLNNFYPKDINVKWKIDGSERQNGVLNS WTDQDSKDSTYSMSSTLTLTKDEYERHNSYTCEATEIKTSTS PIVKSFNRNEC | 738 |
| SM1B308 | LC | DIVMSQSPSSLAVSAGEKVTMSCKSSQSLLNSRTRKNYLAW YQQKPGQSPKLLIYWASTRESGVPDRFTGSGSGTDFTLTISS VQAEDLAVYYCKQSYNLWTFGGGTKLEIKRADAAPTVSIFP PSSEQLTSGGASVVCFLNNFYPKDINVKWKIDGSERQNGVL NSWTDQDSKDSTYSMSSTLTLTKDEYERHNSYTCEATEIKTS TSPIVKSFNRNEC | 739 |
| SM1B309 | LC | DVVMTQTPLSLPVSLGDQASISCRSSQSLLHSNGKTYLHWY LQKPGQSPKLLIYKVSNRFSGVPDRFSGSGSGTDFTLKISRVE AEDLGVYFCSQSTHVPLTFGAGTKLELKRADAAPTVSIFPPS SEQLTSGGASVVCFLNNFYPKDINVKWKIDGSERQNGVLNS WTDQDSKDSTYSMSSTLTLTKDEYERHNSYTCEATEIKTSTS PIVKSFNRNEC | 740 |
| 5M1B310 | LC | DIVMTQSHKFMSTSVGDRVSITCKASQDVSAAVAWYQQKP GQSPKLLIYWASTRHTGVPDRFTGSGSGTDYTLTISSVQAED LALYYCQQHYSTPGTFGGGTKLEIKRADAAPTVSIFPPSSEQ LTSGGASVVCFLNNFYPKDINVKWKIDGSERQNGVLNSWT DQDSKDSTYSMSSTLTLTKDEYERHNSYTCEATEIKTSTSPIV SQTIVHSSGNTYLEWYL | 741 |
| SM1311 | LC | DVLMTQTPLSLPVSLGDQASISCRS QRPGQSPKLLIYKVSNRFSGVPDRFSGSGSGTDFTLKISRVEA EDLGVYYCFQGSHVPYTFGGGTKLEIKRADAAPTVSIFPPSS EQLTSGGASVVCFLNNFYPKDINVKWKIDGSERQNGVLNS WTDQDSKDSTYSMSSTLTLTKDEYERHNSYTCEATEIKTSTS PIVKSFNRNEC | 742 |
| SM1B312 | LC | DIQMTQTTSSLSASLGDRVTISCSASQGISNYLNWYQQKPDG TVKLLIYYTSSLHSGVPSRFSGSGSGTDYSLTISNLEPEDIATY YCQQYSKLPFTFGSGTKLEIKRADAAPTVSIFPPSSEQLTSGG ASVVCFLNNFYPKDINVKWKIDGSERQNGVLNSWTDQDSK DSTYSMSSTLTLTKDEYERHNSYTCEATEIKTSTSPIVKSFNR NEC | 743 |
| SM1B313 | LC | DIVMSQSPSSLAVSVGEKVTMSCKSSQSLLYSSNQKNYLAW YQQKPGQSPKLLIYWASTRESGVPDRLTGSGSGTDFTLTISS VKAEDLAVYYCQQYYSYPYTFGGGTKLEIKRADAAPTVSIF PPSSEQLTSGGASVVCFLNNFYPKDINVKWKIDGSERQNGV LNSWTDQDSKDSTYSMSSTLTLTKDEYERHNSYTCEATHKT STSPIVKSFNRNEC | 744 |
| SM1314 | LC | DIQMTQSPASLSVSVGETVTITCRASENIYSNLAWYQQKQG KSPQLLVYAATNLADGVPSRFSGSGSGTQYSLKINSLQSEDF GSYYCQHFWGTPYTFGGGTKLEIKRADAAPTVSIFPPSSEQL TSGGASVVCFLNNFYPKDINVKWKIDGSERQNGVLNSWTD QDSKDSTYSMSSTLTLTKDEYERHNSYTCEATHKTSTSPIVK SFNRNEC | 745 |
| SM1B315 | LC | DIKMTQSPSSMYASLGERVTITCKASQDINSYLSWFQQKPG KSPKTLIYRANRLVDGPSRFSGSGSGQDYSLTISSLEYEDM GIYYCLQYDEFPYTFGGGTKLEIKRADAAPTVSIFPPSSEQLT SGGASVVCFLNNFYPKDINVKWKIDGSERQNGVLNSWTDQ DSKDSTYSMSSTLTLTKDEYERHNSYTCEATHKTSTSPIVKS FNRNEC | 746 |
| SM1B316 | LC | DIQMTQTTSSLSASLGDRVTISCSASQGISNYLNWYQQKPDG TVKLLIHYTSSLHSGVPSRFSGSGSGTDYSLTISNLEPEDIATY YCQQYSKLPWTFGGGTKLEIKRADAAPTVSIFPPSSEQLTSG | 747 |

TABLE 24-continued

LukE/HlgA Light Chain (LC) and Heavy Chain (HC) Amino Acid Sequences

| mAb/Fab name | region | sequence | SEQ ID NO: |
|---|---|---|---|
| | | GASVVCFLNNFYPKDINVKWKIDGSERQNGVLNSWTDQDS KDSTYSMSSTLTLTKDEYERHNSYTCEATEIKTSTSPIVKSFN RNEC | |
| SM1B317 | LC | DVLMTQTPLSLPVSLGDQASISCRSSQTIVYSDGNTYLEWYL QKPGQSPKLLIYKVSNRFSGVPDRVSGSGSGTDFTLKISRVE AEDLGVYYCFQGSHVPYTFGGGTKLEIKRADAAPTVSIFPPS SEQLTSGGASVVCFLNNFYPKDINVKWKIDGSERQNGVLNS WTDQDSKDSTYSMSSTLTLTKDEYERHNSYTCEATEIKTSTS PIVKSFNRNEC | 748 |
| SM1B318 | LC | DVLMTQTPLSLPVSLGDQASISCRSSQTIVYSDGNTYLEWYL QKPGQSPKLLIYKVSNRFSGVPDRVSGSGSGTDFTLKISRVE AEDLGVYYCFQGSHVPYTFGGGTKLEIKRADAAPTVSIFPPS SEQLTSGGASVVCFLNNFYPKDINVKWKIDGSERQNGVLNS WTDQDSKDSTYSMSSTLTLTKDEYERHNSYTCEATEIKTSTS PIVKSFNRNEC | 749 |
| SM1B319 | LC | DIVMTQAAPSVPVTPGESVSISCRSSKSLLHSNGNTYLYWFL QRPGQSPQLLIYRMSNLASGVPDRFSGSGSGTAFTLRISRVE AEDVGVYYCMQHLEYPFTFGSGTKLEIKRADAAPTVSIFPPS SEQLTSGGASVVCFLNNFYPKDINVKWKIDGSERQNGVLNS WTDQDSKDSTYSMSSTLTLTKDEYERHNSYTCEATEIKTSTS PIVKSFNRNEC | 750 |
| SM1B320 | LC | DIQMTQTTSSLSASLGDRVTISCSASQGISNYLNWYQQKPDG TVKLLIYYTSSLHSGVPSRFSGSGSGTDYSLTISNLEPEDIATY YCQQYSKLPYTFGGGTKLEIKRADAAPTVSIFPPSSEQLTSG GASVVCFLNNFYPKDINVKWKIDGSERQNGVLNSWTDQDS KDSTYSMS STLTLTKDEYERHNSYTCEATEIKTSTSPIVKSFN RNEC | 751 |
| SM1321 | LC | DIQMTQSPASLSASVGETVTIICRASENIYSYLAWYQQKQGK SPQLLVYNAKTLVEGVPSRFSGSGSGTQFSLKINSLQPEDFG SYYCQHHYGSPYTFGGGTKLEIKRADAAPTVSIFPPSSEQLT SGGASVVCFLNNFYPKDINVKWKIDGSERQNGVLNSWTDQ DSKDSTYSMSSTLTLTKDEYERHNSYTCEATHKTSTSPIVKS FNRNEC | 752 |
| 5M1B322 | LC | DIVMTQSHKFMSTSVGDRVSITCKASQDVSTAVAWYQQKP GQSPKLLIYSASYRYTGVPDRFTGSGSGTDFTFTISSVQAEDL AVYYCQQHYSTPWTFGGGTKLEIKRADAAPTVSIFPPSSEQL TSGGASVVCFLNNFYPKDINVKWKIDGSERQNGVLNSWTD QDSKDSTYSMSSTLTLTKDEYERHNSYTCEATHKTSTSPIVK SFNRNEC | 753 |
| SM1B323 | LC | ETTVTQSPASLSMAIGEKVTIRCITSTDIDDDMNWYQQKPGE PPKKLLISEGNTLRPGVPSRFSSSGYGTDFVFTIENMLSEDVAD YYCLQSDNLPYTFGGGTKLEIKRADAAPTVSIFPPSSEQLTSG GASVVCFLNNFYPKDINVKWKIDGSERQNGVLNSWTDQDS KDSTYSMSSTLTLTKDEYERHNSYTCEATEIKTSTSPIVKSFN RNEC | 754 |
| SM1B324 | LC | DIVMTQSPSSLSVSAGEKVTMSCKSSQSLLNSGNQKNYLAW YQQKPGQPPKLLIYGASTRESGVPDRFTGSGSGTDFTLTISSV QAEDLAVYYCQNDHSYPPTFGGGTKLEIKRADAAPTVSIFPP SSEQLTSGGASVVCFLNNFYPKDINVKWKIDGSERQNGVLN SWTDQDSKDSTYSMSSTLTLTKDEYERHNSYTCEATEIKTST SPIVKSFNRNEC | 755 |
| SM1B325 | LC | DIQMTQSPSSLSASLGERVSLTCRASQDIGNSLNWLQQKPDG TIKRLIYATSNLDSGVPKRFSGSRSGSDYSLTISSLESEDFVN YYCLQFASSPLTFGTGTKLEIKRADAAPTVSIFPPSSEQLTSG GASVVCFLNNFYPKDINVKWKIDGSERQNGVLNSWTDQDS KDSTYSMSSTLTLTKDEYERHNSYTCEATEIKTSTSPIVKSFN RNEC | 756 |
| 5M1B326 | LC | DIQMTQSPASLSVSVGETVTITCRASENIYSNLAWYQQKQG KSPQLLVYAATNLADGVPSRFSGSGSGTQYSLKINSLQSEDF GSYYCQHFWGTPYTFGGGTKLEIKRADAAPTVSIFPPSSEQL TSGGASVVCFLNNFYPKDINVKWKIDGSERQNGVLNSWTD QDSKDSTYSMSSTLTLTKDEYERHNSYTCEATHKTSTSPIVK SFNRNEC | 757 |

TABLE 24-continued

LukE/HlgA Light Chain (LC) and Heavy Chain (HC) Amino Acid Sequences

| mAb/Fab name | region | sequence | SEQ ID NO: |
|---|---|---|---|
| SM1B327 | LC | QIVLTQSPAIMSASPGEKVTMTCSASSNVSYMEIWFQQKSGT SPKRWIYDTSKLASGVPARFSGSGSGTSYSLTVSSMEAEDA ATYYCQQWSSNPRTFGGGTKLEIKRADAAPTVSIFPPSSEQL TSGGASVVCFLNNFYPKDINVKWKIDGSERQNGVLNSWTD QDSKDSTYSMSSTLTLTKDEYERHNSYTCEATHKTSTSPIVK SFNRNEC | 758 |
| SM1B328 | LC | DIQMTQSPSSLSASLGERVSLTCRASQDIGSYLNWLQQEPDG TIKRLIYATSSLDSGVPKRFSGSRSGADYSLTISSLESEDFVD YYCLQYATSPWTFGGGTKLEIKRADAAPTVSIFPPSSEQLTS GGASVVCFLNNFYPKDINVKWKIDGSERQNGVLNSWTDQD SKDSTYSMSSTLTLTKDEYERHNSYTCEATHKTSTSPIVKSF NRNEC | 759 |
| SM1B329 | LC | DIQMTQSSSYLSVSLGGRVTITCKASDHINNWLAWYQQKPG NAPRLLISGATSLETGVPSRFSGSGSGKDYTLSITSLQTEDVA TYYCQQYWSTPYTFGGGTKLEIKRADAAPTVSIFPPS SE QLT SGGASVVCFLNNFYPKDINVKWKIDGSERQNGVLNSWTDQ DSKDSTYSMSSTLTLTKDEYERHNSYTCEATHKTSTSPIVKS FNRNEC | 760 |
| SM1B330 | LC | QIVLTQSPALMSASPGEKVTMTCSASSSVSYMYWYQQKPRS SPKLKYASNLASGVPARFSGSGSGTSYSLTISSMEAEDAATY YCQQWSSNPPITFGAGTKLELKRADAAPTVSIFPPSSEQLTSG GASVVCFLNNFYPKDINVKWKIDGSERQNGVLNSWTDQDS KDSTYSMSSTLTLTKDEYERHNSYTCEATEIKTSTSPIVKSFN RNEC | 761 |
| SM1331 | LC | DIVMTQSPATLSVTPGDRVSLSCRASQSISDYLHWYQQKSH ESPRLLIKYDSQSISGIPSRFSGSGSGSDFTLSINSVEPEDVGV YYCQNGEIRFPFTFGGGTKLEIKRADAAPTVSIFPPSSEQLTSG GASVVCFLNNFYPKDINVKWKIDGSERQNGVLNSWTDQDS KDSTYSMSSTLTLTKDEYERHNSYTCEATEIKTSTSPIVKSFN RNEC | 762 |
| SM1B332 | LC | QIVLTQSPAIMSASPGEKVTLTCSASSSVSSSYLFWYQQKPG SSPKLWIYSTSNLASGVPVRFSGSGSGFGTSYSLTISRMEAEDA ASYFCHQWSSYPPTFGAGTKLELKRADAAPTVSIFPPSSEQL TSGGASVVCFLNNFYPKDINVKWKIDGSERQNGVLNSWTD QDSKDSTYSMSSTLTLTKDEYERHNSYTCEATHKTSTSPIVK SFNRNEC | 763 |
| SM1B333 | LC | DIVLTQSPASLAVSLGQRATISCRASESVDSYGNSFMEIWYQ QKPGQPPKLLIYLASNLESGVPARFSGSGSRTDFTLTIDPVEA DDAATYYCQQNNEDPYTFGGGTKLEIKRADAAPTVSIFPPSS EQLTSGGASVVCFLNNFYPKDINVKWKIDGSERQNGVLNS WTDQDSKDSTYSMSSTLTLTKDEYERHNSYTCEATEIKTSTS PIVKSFNRNEC | 764 |
| SM1B334 | LC | DVLMTQTPLSLPVSLGDQASISCRSSQSIVYSNGNTYLDWYL QKPGQPPKLLIYKVSNRFSGVPDRFSGSGSGTDFILKISRVEA EDLGVYYCFQGSHVPWTFGGGTKLEIKRADAAPTVSIFPPSS EQLTSGGASVVCFLNNFYPKDINVKWKIDGSERQNGVLNS WTDQDSKDSTYSMSSTLTLTKDEYERHNSYTCEATEIKTSTS PIVKSFNRNEC | 765 |
| SM1B335 | LC | DVVVTQTPLSLPVSFGDQVSISCRSSQSLANSYGNTYLSWYL EIKPGQSPQLLIYGISNRFSGVPDRFSGSGSGTDFTLKISTIKPE DLGMYYCLQGTHQPYTFGGGTKLEIKRADAAPTVSIFPPSSE QLTSGGASVVCFLNNFYPKDINVKWKIDGSERQNGVLNSW TDQDSKDSTYSMSSTLTLTKDEYERHNSYTCEATEIKTSTSPI VKSFNRNEC | 766 |
| SM1B336 | LC | DIVMSQSPSSLAVSVGEKVTMSCKSSQSVLYNSNQRNYLA WYQQKPGQSPKLLIYWASTRESGVPDRSTGSGSGTDFTLTIS SVQAEDLAVYYCHQYLSSYTFGGGTKLEIKRADAAPTVSIFP PSSEQLTSGGASVVCFLNNFYPKDINVKWKIDGSERQNGVL NSWTDQDSKDSTYSMSSTLTLTKDEYERHNSYTCEATEIKTS TSPIVKSFNRNEC | 767 |
| SM1B337 | LC | DIVMTQSHKFMSTSVGDRVSITCKASQDVGTAVAWYQQKP GQSPKLLIYWASTRHTGVPDRFTGSGSGTDFTLTISNVQSED LADYFCQQYSSYPLTFGAGTKLELKRADAAPTVSIFPPSSEQ LTSGGASVVCFLNNFYPKDINVKWKIDGSERQNGVLNSWT | 768 |

TABLE 24-continued

LukE/HlgA Light Chain (LC) and Heavy Chain (HC) Amino Acid Sequences

| mAb/Fab name | region | sequence | SEQ ID NO: |
|---|---|---|---|
| | | DQDSKDSTYSMSSTLTLTKDEYERHNSYTCEATEIKTSTSPIVKSFNRNEC | |
| SM1B338 | LC | DIVLTQSPASLAVSLGQRATISCRASESVDSYGNSFMEIWYQQKPGQPPKLLIYRASNLESGIPARFSGSGSRTDFTLTINPVEADDVATYYCQQSNEDPPWTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATEIKTSTSPIVKSFNRNEC | 769 |
| SM1B339 | LC | DIVLTQSPASLAVSLGQRATISCRASESVDSYGNSFMHWYQQKPGQPPKLLIYRASNLESGIPARFSGSGSRTDFTLTINPVEADDVATYYCQQSNEDPPWTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATEIKTSTSPIVKSFNRNEC | 770 |
| 5M1B340 | LC | DIQMTQTTSSLSASLGDRVTISCRASQDIDNYLNWYQQKPDGTVKLLISYTSRLHSGVPSRFSGSGSGTDYSLTISNLEQEDFATYFCQQGYTLPWTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC | 771 |
| SM1B302 | HC | EVKLVESGGDLVKPGGSLKLSCAASGFTFSSFAMSWVRQTPEKRLEWVASISRTDNTYYPDSMKGQFTISRDNARNILYLQMSSLRSENTAIYYCARADYDGPWFAYWGQGTLVTVSAAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNEIHTTKSFSRTPGK | 772 |
| 5M1B303 | HC | EVQLQQSGPDLVKPGTSVKMSCKASGYSFTGYYMHWVKQSHGKSLEWIGRVNPNNGGTSYNQKFKGKAILTVDKSSSTAYMELRSLTSEDSAVYYCARDDYSFAYWGQGTLVTVSAAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNEIHTTKSFSRTPGK | 773 |
| SM1B304 | HC | EVKLVESGGGLVQPGGSLRLSCATSGFTFTDFYMSWVRQPPGKALEWLAFIRNKANGYTTEYSSSVRGRFTISRDNSQSILYLQMNTLRAEDSGTYYCARDVGDYDYWGQGSTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNEIHTTKSFSRTPGK | 774 |
| 5M1B305 | HC | QIQLVQSGPELKKPGETVKISCKASGFTFTNYGMNWVKQAPGKDLKWMGWINTYTGEPTYADDFKGRFAFSLETSASTAYLQINNLKDEDTASYFCARDYRDGDALDYWGQGTSVTVSSAKTTAPSVYPLAPVCGDTTGSSVTLGCLVKGYFPEPVTLTWNSGSLSSGVHTFPAVLQSDLYTLSSSVTVTSSTWPSQSITCNVAEWASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNEIHTTKSFSRTPGK | 775 |
| 5M1B306 | HC | QVQLQQPGAELVRPGASVKLSCKASGYSFTSNWMNWMKQRPGQGLEWIGMTHPSDSESRLNQKFKDKATLTVDKSSSTAY | 776 |

TABLE 24-continued

LukE/HlgA Light Chain (LC) and Heavy Chain (HC) Amino Acid Sequences

| mAb/Fab name | region | sequence | SEQ ID NO: |
|---|---|---|---|
| | | MQLSSPTSEDSAVYYCARGDGGFAYWGQGTLVTVSAAKTT APSVYPLAPVCGDTTGSSVTLGCLVKGYFPEPVTLTWNSGS LSSGVHTFPAVLQSDLYTLSSSVTVTSSTWPSQSITCNVAHP ASSTKVDKKIEPRGPTIKPCPPCKCPAPNLLGGPSVFIFPPKIK DVLMISLSPIVTCVVVDVSEDDPDVQISWFVNNVEVHTAQT QTHREDYNSTLRVVSALPIQHQDWMSGKEFKCKVNNKDLP APIERTISKPKGSVRAPQVYVLPPPEEEMTKKQVTLTCMVTD FMPEDIYVEWTNNGKTELNYKNTEPVLDSDGSYFMYSKLR VEKKNWVERNSYSCSVVHEGLHNEIHTTKSFSRTPGK | |
| 5M1B307 | HC | EVKLQQSGPELVKPGASMKISCKASGYSFTGYTMNWAKQS HGKNLEWIGLINPYNGGTSYNQKFKGKATLTVDKSSSTAY MELLSLTSEDSAVYYCARGYPRGWFAYWGQGTLVTVSAA KTTAPSVYPLAPVCGDTTGSSVTLGCLVKGYFPEPVTLTWN SGSLSSGVHTFPAVLQSDLYTLSSSVTVTSSTWPSQSITCNVA EWASSTKVDKKIEPRGPTIKPCPPCKCPAPNLLGGPSVFIFPPK IKDVLMISLSPIVTCVVVDVSEDDPDVQISWFVNNVEVHTA QTQTHREDYNSTLRVVSALPIQHQDWMSGKEFKCKVNNKD LPAPIERTISKPKGSVRAPQVYVLPPPEEEMTKKQVTLTCMV TDFMPEDIYVEWTNNGKTELNYKNTEPVLDSDGSYFMYSK LRVEKKNWVERNSYSCSVVHEGLHNEIHTTKSFSRTPGK | 777 |
| 5M1B308 | HC | DVKLVESGGGLVKPGGSLKLSCAASGFTFRNHAMSWVRQT PEKRLEWVAAINVNAGSTYYPDTVKDRFTISRDNAKNTLYL QMSSLRSEDTALYYCARHRAYYNYDENAMDYWGQGTSVT VSSAKTTAPSVYPLAPVCGDTTGSSVTLGCLVKGYFPEPVTL TWNSGSLSSGVHTFPAVLQSDLYTLSSSVTVTSSTWPSQSIT CNVAHPASSTKVDKKIEPRGPTIKPCPPCKCPAPNLLGGPSV FIFPPKIKDVLMISLSPIVTCVVVDVSEDDPDVQISWFVNNVE VHTAQTQTHREDYNSTLRVVSALPIQHQDWMSGKEFKCKV NNKDLPAPIERTISKPKGSVRAPQVYVLPPPEEEMTKKQVTL TCMVTDFMPEDIYVEWTNNGKTELNYKNTEPVLDSDGSYF MYSKLRVEKKNWVERNSYSCSVVEIEGLHNEIHTTKSFSRTP GK | 778 |
| 5M1B309 | HC | EVQLQQSGPELVKPGDSVKMSCKASGYTFTDYYIDWMKQS HGKSLEWIGYIYPNNGGTSYNQNFKDKATLTVDKSSSTAY MELHSLTSEDSAVYYCARLTYYAKVDSWGQGTSVTVSSAK TTAPSVYPLAPVCGDTTGSSVTLGCLVKGYFPEPVTLTWNS GSLSSGVHTFPAVLQSDLYTLSSSVTVTSSTWPSQSITCNVA EWASSTKVDKKIEPRGPTIKPCPPCKCPAPNLLGGPSVFIFPPK IKDVLMISLSPIVTCVVVDVSEDDPDVQISWFVNNVEVHTA QTQTHREDYNSTLRVVSALPIQHQDWMSGKEFKCKVNNKD LPAPIERTISKPKGSVRAPQVYVLPPPEEEMTKKQVTLTCMV TDFMPEDIYVEWTNNGKTELNYKNTEPVLDSDGSYFMYSK LRVEKKNWVERNSYSCSVVHEGLHNEIHTTKSFSRTPGK | 779 |
| 5M1B310 | HC | DVKLVESGGGLVEWEGVLKLSCAASGFTFSSYAMSWVRQT PEKRLEWVAAINSNGGSTYYPDTVKDRFTISRDNAKNTLYL QMSSLRSEDTALYYCARLYYGDYWGQGTTLTVSSAKTTAP SVYPLAPVCGDTTGSSVTLGCLVKGYFPEPVTLTWNSGSLSS GVHTFPAVLQSDLYTLSSSVTVTSSTWPSQSITCNVAHPASS TKVDKKIEPRGPTIKPCPPCKCPAPNLLGGPSVFIFPPKIDVL MISLSPIVTCVVVDVSEDDPDVQISWFVNNVEVHTAQTQTH REDYNSTLRVVSALPIQHQDWMSGKEFKCKVNNKDLPAPIE RTISKPKGSVRAPQVYVLPPPEEEMTKKQVTLTCMVTDFMP EDIYVEWTNNGKTELNYKNTEPVLDSDGSYFMYSKLRVEK KNWVERNSYSCSVVEIEGLHNEIHTTKSFSRTPGK | 780 |
| SM1B311 | HC | QVQLKQSGPSLVQPSQSLSITCTVSGFSLTTYGLHWIRQSPG KGLEWLGVIWRGGTTDYNAAFMSRLTITKDNSKSQVFFKM NSLQADDTAIYYCARTDIWGAGTTVTVSSAKTTAPSVYPLA PVCGDTTGSSVTLGCLVKGYFPEPVTLTWNSGSLSSGVHTFP AVLQSDLYTLSSSVTVTSSTWPSQSITCNVAHPASSTKVDKK IEPRGPTIKPCPPCKCPAPNLLGGPSVFIFPPKIKDVLMISLSPI VTCVVVDVSEDDPDVQISWFVNNVEVHTAQTQTHREDYNS TLRVVSALPIQHQDWMSGKEFKCKVNNKDLPAPIERTISKP KGSVRAPQVYVLPPPEEEMTKKQVTLTCMVTDFMPEDIYVE WTNNGKTELNYKNTEPVLDSDGSYFMYSKLRVEKKNWVE RNSYSCSVVEIEGLHNEIHTTKSFSRTPGK | 781 |
| SM1B312 | HC | QVQLKQSGPSLVQPSQSLSITCTVSGFSLTTYGLHWIRQSPG KGLEWLGVIWRGGTTDYNAAFMSRLTITKDNSKSQVFFKM NSLQADDTAIYYCARTDIWGAGTTVTVSSAKTTAPSVYPLA | 782 |

TABLE 24-continued

LukE/HlgA Light Chain (LC) and Heavy Chain (HC) Amino Acid Sequences

| mAb/Fab name | region | sequence | SEQ ID NO: |
|---|---|---|---|
| | | PVCGDTTGSSVTLGCLVKGYFPEPVTLTWNSGSLSSGVHTFP AVLQSDLYTLSSSVTVTSSTWPSQSITCNVAHPASSTKVDKK IEPRGPTIKPCPPCKCPAPNLLGGPSVFIFPPKIKDVLMISLSPI VTCVVVDVSEDDPDVQISWFVNNVEVHTAQTQTHREDYNS TLRVVSALPIQHQDWMSGKEFKCKVNNKDLPAPIERTISKP KGSVRAPQVYVLPPPEEEMTKKQVTLTCMVTDFMPEDIYVE WTNNGKTELNYKNTEPVLDSDGSYFMYSKLRVEKKNWVE RNSYSCSVVEIEGLHNEIHTTKSFSRTPGK | |
| SM1B313 | HC | QVQLKQSGPSLVQPSQSLSITCTVSGFSLTTYGLHWIRQSPG KGLEWLGVIWRGGTTDYNAAFMSRLTITKDNSKSQVFFKM NSLQADDTAIYYCARTDIWGAGTTVTVSSAKTTAPSVYPLA PVCGDTTGSSVTLGCLVKGYFPEPVTLTWNSGSLSSGVHTFP AVLQSDLYTLSSSVTVTSSTWPSQSITCNVAHPASSTKVDKK IEPRGPTIKPCPPCKCPAPNLLGGPSVFIFPPKIKDVLMISLSPI VTCVVVDVSEDDPDVQISWFVNNVEVHTAQTQTHREDYNS TLRVVSALPIQHQDWMSGKEFKCKVNNKDLPAPIERTISKP KGSVRAPQVYVLPPPEEEMTKKQVTLTCMVTDFMPEDIYVE WTNNGKTELNYKNTEPVLDSDGSYFMYSKLRVEKKNWVE RNSYSCSVVEIEGLHNEIHTTKSFSRTPGK | 783 |
| SM1B314 | HC | QVQLKQSGPGLVQPSQSLPITCTVSGFSLTTYGLHWIRQSPG KGLEWLGVIWRGGTTDYNAAFMSRLTITKDNSKSQVFFKM NSLQADDTAIYYCARTDIWGAGTTVTVSSAKTTAPSVYPLA PVCGDTTGSSVTLGCLVKGYFPEPVTLTWNSGSLSSGVHTFP AVLQSDLYTLSSSVTVTSSTWPSQSITCNVAHPASSTKVDKK IEPRGPTIKPCPPCKCPAPNLLGGPSVFIFPPKIKDVLMISLSPI VTCVVVDVSEDDPDVQISWFVNNVEVHTAQTQTHREDYNS TLRVVSALPIQHQDWMSGKEFKCKVNNKDLPAPIERTISKP KGSVRAPQVYVLPPPEEEMTKKQVTLTCMVTDFMPEDIYVE WTNNGKTELNYKNTEPVLDSDGSYFMYSKLRVEKKNWVE RNSYSCSVVEIEGLHNEIHTTKSFSRTPGK | 784 |
| SM1B315 | HC | QVQLKQSGPGLVQPSQSLSITCTVSGFSLTTYGLHWIRQSPG KGLEWLGVIWRGGTTDYNAAFMSRLTITKDNSKSQVFFKM NSLQADDTAIYYCARTDIWGAGTTVTVSSAKTTAPSVYPLA PVCGDTTGSSVTLGCLVKGYFPEPVTLTWNSGSLSSGVHTFP AVLQSDLYTLSSSVTVTSSTWPSQSITCNVAHPASSTKVDKK IEPRGPTIKPCPPCKCPAPNLLGGPSVFIFPPKIKDVLMISLSPI VTCVVVDVSEDDPDVQISWFVNNVEVHTAQTQTHREDYNS TLRVVSALPIQHQDWMSGKEFKCKVNNKDLPAPIERTISKP KGSVRAPQVYVLPPPEEEMTKKQVTLTCMVTDFMPEDIYVE WTNNGKTELNYKNTEPVLDSDGSYFMYSKLRVEKKNWVE RNSYSCSVVEIEGLHNEIHTTKSFSRTPGK | 785 |
| SM1B316 | HC | QVQLKQSGPSLVQPSQSLSITCTVSGFSLTTYGLHWIRQSPG KGLEWLGVIWRGGTTDYNAAFMSRLTITKDNSKSQVFFKM NSLQADDTAIYYCARTDIWGAGTTVTVSSAKTTAPSVYPLA PVCGDTTGSSVTLGCLVKGYFPEPVTLTWNSGSLSSGVHTFP AVLQSDLYTLSSSVTVTSSTWPSQSITCNVAHPASSTKVDKK IEPRGPTIKPCPPCKCPAPNLLGGPSVFIFPPKIKDVLMISLSPI VTCVVVDVSEDDPDVQISWFVNNVEVHTAQTQTHREDYNS TLRVVSALPIQHQDWMSGKEFKCKVNNKDLPAPIERTISKP KGSVRAPQVYVLPPPEEEMTKKQVTLTCMVTDFMPEDIYVE WTNNGKTELNYKNTEPVLDSDGSYFMYSKLRVEKKNWVE RNSYSCSVVEIEGLHNEIHTTKSFSRTPGK | 786 |
| SM1B317 | HC | QVQLKQSGPGLVQPSQSLSITCTVSGFSLTSYGVHWVRQPP GKGLEWLGVIWSGGITDYNAAFISRLSISKDNSKSQVFFKM NSLQADDTAIYYCARTDLWGQGTLVTVSAAKTTAPSVYPL APVCGDTTGSSVTLGCLVKGYFPEPVTLTWNSGSLSSGVHT FPAVLQSDLYTLSSSVTVTSSTWPSQSITCNVAHPASSTKVD KKIEPRGPTIKPCPPCKCPAPNLLGGPSVFIFPPKIKDVLMISL SPIVTCVVVDVSEDDPDVQISWFVNNVEVHTAQTQTHREDY NSTLRVVSALPIQHQDWMSGKEFKCKVNNKDLPAPIERTIS KPKGSVRAPQVYVLPPPEEEMTKKQVTLTCMVTDFMPEDIY VEWTNNGKTELNYKNTEPVLDSDGSYFMYSKLRVEKKNW VERNSYSCSVVHEGLHNEIHTTKSFSRTPGK | 787 |
| 5M1B318 | HC | QVQLQQSGAELMNPGASVKISCKSTGYKFSSYWIEWVKQR PGHGLEWMGEILPGSGSTNHNEKFKGKAIFTADASSNTAYM ELSSLTSEDSAVYYCARTISTATDWFAYWGQGTLVTVSAAK TTAPSVYPLAPVCGDTTGSSVTLGCLVKGYFPEPVTLTWNS GSLSSGVHTFPAVLQSDLYTLSSSVTVTSSTWPSQSITCNVA EWASSTKVDKKIEPRGPTIKPCPPCKCPAPNLLGGPSVFIFPPK | 788 |

TABLE 24-continued

LukE/HlgA Light Chain (LC) and Heavy Chain (HC) Amino Acid Sequences

| mAb/Fab name | region | sequence | SEQ ID NO: |
|---|---|---|---|
| | | IKDVLMISLSPIVTCVVVDVSEDDPDVQISWFVNNVEVHTA QTQTHREDYNSTLRVVSALPIQHQDWMSGKEFKCKVNNKD LPAPIERTISKPKGSVRAPQVYVLPPPEEEMTKKQVTLTCMV TDFMPEDIYVEWTNNGKTELNYKNTEPVLDSDGSYFMYSK LRVEKKNWVERNSYSCSVVHEGLHNEIHTTKSFSRTPGK | |
| 5M1B319 | HC | QVQLQQSGAELMNPGASVKISCKSTGYKFSSYWIEWVKQR PGHGLEWMGEILPGSGSTNHNEKFKGKAIFTADASSNTAYM ELSSLTSEDSAVYYCARTISTATDWFAYWGQGTLVTVSAAK TTAPSVYPLAPVCGDTTGSSVTLGCLVKGYFPEPVTLTWNS GSLSSGVHTFPAVLQSDLYTLSSSVTVTSSTWPSQSITCNVA EWASSTKVDKKIEPRGPTIKPCPPCKCPAPNLLGGPSVFIFPPK IKDVLMISLSPIVTCVVVDVSEDDPDVQISWFVNNVEVHTA QTQTHREDYNSTLRVVSALPIQHQDWMSGKEFKCKVNNKD LPAPIERTISKPKGSVRAPQVYVLPPPEEEMTKKQVTLTCMV TDFMPEDIYVEWTNNGKTELNYKNTEPVLDSDGSYFMYSK LRVEKKNWVERNSYSCSVVHEGLHNEIHTTKSFSRTPGK | 789 |
| 5M1B320 | HC | QVQLQQSGAELMKPGASVKMSCKATGYKFSSYWIEWVKQ RPGHGLEWMGEILPGSGSTNHNEKFKGKAIFTADASSNTAY MELSSLTSEDSAVYYCARTISTATDWFAYWGQGTLVTVSA AKTTAPSVYPLAPVCGDTTGSSVTLGCLVKGYFPEPVTLTW NSGSLSSGVHTFPAVLQSDLYTLSSSVTVTSSTWPSQSITCNV AHPASSTKVDKKIEPRGPTIKPCPPCKCPAPNLLGGPSVFIFPP KIKDVLMISLSPIVTCVVVDVSEDDPDVQISWFVNNVEVHT AQTQTHREDYNSTLRVVSALPIQHQDWMSGKEFKCKVNNK DLPAPIERTISKPKGSVRAPQVYVLPPPEEEMTKKQVTLTCM VTDFMPEDIYVEWTNNGKTELNYKNTEPVLDSDGSYFMYS KLRVEKKNWVERNSYSCSVVHEGLHNEIHTTKSFSRTPGK | 790 |
| 5M1B321 | HC | QVQLQQSGAELMKPGASVKMSCKATGYKFSSYWIEWVKQ RPGHGLEWMGEILPGSGSTNHNEKFTGRAIFTADASSNTAY MELSSLTSEDSAVYYCARTISTATDWFAYWGQGTLVTVSA AKTTAPSVYPLAPVCGDTTGSSVTLGCLVKGYFPEPVTLTW NSGSLSSGVHTFPAVLQSDLYTLSSSVTVTSSTWPSQSITCNV AHPASSTKVDKKIEPRGPTIKPCPPCKCPAPNLLGGPSVFIFPP KIKDVLMISLSPIVTCVVVDVSEDDPDVQISWFVNNVEVHT AQTQTEIREDYNSTLRVVSALPIQHQDWMSGKEFKCKVNNK DLPAPIERTISKPKGSVRAPQVYVLPPPEEEMTKKQVTLTCM VTDFMPEDIYVEWTNNGKTELNYKNTEPVLDSDGSYFMYS KLRVEKKNWVERNSYSCSVVHEGLHNEIHTTKSFSRTPGK | 791 |
| 5M1B322 | HC | QVQLQQSGAELMKPGASVKMSCKATGYKFSSYWIEWVKQ RPGHGLEWMGEILPGSGSTNHNEKFKGKAIFTADASSNTAY MELSSLTSEDSAVYYCARTISTATDWFAYWGQGTLVTVSA AKTTAPSVYPLAPVCGDTTGSSVTLGCLVKGYFPEPVTLTW NSGSLSSGVHTFPAVLQSDLYTLSSSVTVTSSTWPSQSITCNV AHPASSTKVDKKIEPRGPTIKPCPPCKCPAPNLLGGPSVFIFPP KIKDVLMISLSPIVTCVVVDVSEDDPDVQISWFVNNVEVHT AQTQTEIREDYNSTLRVVSALPIQHQDWMSGKEFKCKVNNK DLPAPIERTISKPKGSVRAPQVYVLPPPEEEMTKKQVTLTCM VTDFMPEDIYVEWTNNGKTELNYKNTEPVLDSDGSYFMYS KLRVEKKNWVERNSYSCSVVHEGLHNEIHTTKSFSRTPGK | 792 |
| 5M1B323 | HC | QVQLQQSGAELMKPGASVKMPCKATGYKFSSYWIEWVKQ RPGHGLEWMGEILPGSGSTNHNEKFKGKAIFTADASSNTAY MELSSLTSEDSAVYYCARTISTATDWFAYWGQGTLVTVSA AKTTAPSVYPLAPVCGDTTGSSVTLGCLVKGYFPEPVTLTW NSGSLSSGVHTFPAVLQSDLYTLSSSVTVTSSTWPSQSITCNV AHPASSTKVDKKIEPRGPTIKPCPPCKCPAPNLLGGPSVFIFPP KIKDVLMISLSPIVTCVVVDVSEDDPDVQISWFVNNVEVHT AQTQTEIREDYNSTLRVVSALPIQHQDWMSGKEFKCKVNNK DLPAPIERTISKPKGSVRAPQVYVLPPPEEEMTKKQVTLTCM VTDFMPEDIYVEWTNNGKTELNYKNTEPVLDSDGSYFMYS KLRVEKKNWVERNSYSCSVVHEGLHNEIHTTKSFSRTPGK | 793 |
| 5M1B324 | HC | EVQLQQSGAELVRPGALVKLSCKASGFNIKDYYMHWVKQR PEQGLEWIGWIDPENGNTIYDPKFQGKASITADTSSNTAYLQ LSSLTSEDTAVYYCARYDGYAMDYWGQGTSVTVSSAKTTA PSVYPLAPVCGDTTGSSVTLGCLVKGYFPEPVTLTWNSGSLS SGVHTFPAVLQSDLYTLSSSVTVTSSTWPSQSITCNVAHPAS STKVDKKIEPRGPTIKPCPPCKCPAPNLLGGPSVFIFPPKIDV LMISLSPIVTCVVVDVSEDDPDVQISWFVNNVEVHTAQTQT EIREDYNSTLRVVSALPIQHQDWMSGKEFKCKVNNKDLPAPI | 794 |

TABLE 24-continued

LukE/HlgA Light Chain (LC) and Heavy Chain (HC) Amino Acid Sequences

| mAb/Fab name | region | sequence | SEQ ID NO: |
|---|---|---|---|
| | | ERTISKPKGSVRAPQVYVLPPPEEEMTKKQVTLTCMVTDFM PEDIYVEWTNNGKTELNYKNTEPVLDSDGSYFMYSKLRVE KKNWVERNSYSCSVVHEGLHMiHTTKSFSRTPGK | |
| 5M1B325 | HC | QVQLQQSGAELVRPGTSVKMSCKAAGYTFTNYWIGWVKQ RPGHGLEWIGDIYPGGGYTNYNEKFKDKTTLTADTSSNTAY MQLSSLTSEDSAIYYCASNDCWGQGTTLTVSSAKTTAPSVY PLAPVCGDTTGSSVTLGCLVKGYFPEPVTLTWNSGSLSSGV HTFPAVLQSDLYTLSSSVTVTSSTWPSQSITCNVAHPASSTK VDKKIEPRGPTIKPCPPCKCPAPNLLGGPSVFIFPPKIKDVLMI SLSPIVTCVVVDVSEDDPDVQISWFVNNVEVHTAQTQTHRE DYNSTLRVVSALPIQHQDWMSGKEFKCKVNNKDLPAPIERT ISKPKGSVRAPQVYVLPPPEEEMTKKQVTLTCMVTDFMPED IYVEWTNNGKTELNYKNTEPVLDSDGSYFMYSKLRVEKKN WVERNSYSCSVVHEGLHNEIHTTKSFSRTPGK | 795 |
| SM1B326 | HC | QVQLKQSGPGLVQPSQSLSITCTVSGFSITSYGVHWIRQSPG KGLEWLGVIWSGGSTDYNAAFISRLSISEDNSKSQVFFKMNS LQANDTAIYYCATFYYDYDEGFDYWGQGTTLTVSSAKTTA PSVYPLAPVCGDTTGSSVTLGCLVKGYFPEPVTLTWNSGSLS SGVHTFPAVLQSDLYTLSSSVTVTSSTWPSQSITCNVAHPAS STKVDKKIEPRGPTIKPCPPCKCPAPNLLGGPSVFIFPPKIKDV LMISLSPIVTCVVVDVSEDDPDVQISWFVNNVEVHTAQTQT EIREDYNSTLRVVSALPIQHQDWMSGKEFKCKVNNKDLPAPI ERTISKPKGSVRAPQVYVLPPPEEEMTKKQVTLTCMVTDFM PEDIYVEWTNNGKTELNYKNTEPVLDSDGSYFMYSKLRVE KKNWVERNSYSCSVVHEGLHMIHTTKSFSRTPGK | 796 |
| SM1B327 | HC | QVQLKQSGPGLVQPSQSLSITCTVSGFSITSYGVHWIRQSPG KGLEWLGVIWSGGSTDYNAAFISRLSISKDNSKSQVFFKMN SLQANDTAIYYCATFYYDYDEGFDYWGQGTTLTVSSAKTT APSVYPLAPVCGDTTGSSVTLGCLVKGYFPEPVTLTWNSGS LSSGVHTFPAVLQSDLYTLSSSVTVTSSTWPSQSITCNVAHP ASSTKVDKKIEPRGPTIKPCPPCKCPAPNLLGGPSVFIFPPKIK DVLMISLSPIVTCVVVDVSEDDPDVQISWFVNNVEVHTAQT QTEIREDYNSTLRVVSALPIQHQDWMSGKEFKCKVNNKDLP APIERTISKPKGSVRAPQVYVLPPPEEEMTKKQVTLTCMVTD FMPEDIYVEWTNNGKTELNYKNTEPVLDSDGSYFMYSKLR VEKKNWVERNSYSCSVVHEGLHNEIHTTKSFSRTPGK | 797 |
| SM1B328 | HC | QVQLKQSGPGLVQPSQSLSITCTVSGFSITSYGVHWIRQSPG KGLEWLGVIWSGGSTDYNAAFISRLSISKDNSKSQVFFKMN SLQANDTAIYYCATFYYDYDEGFDYWGQGTTLTVSSAKTT APSVYPLAPVCGDTTGSSVTLGCLVKGYFPEPVTLTWNSGS LSSGVHTFPAVLQSDLYTLSSSVTVTSSTWPSQSITCNVAHP ASSTKVDKKIEPRGPTIKPCPPCKCPAPNLLGGPSVFIFPPKIK DVLMISLSPIVTCVVVDVSEDDPDVQISWFVNNVEVHTAQT QTEIREDYNSTLRVVSALPIQHQDWMSGKEFKCKVNNKDLP APIERTISKPKGSVRAPQVYVLPPPEEEMTKKQVTLTCMVTD FMPEDIYVEWTNNGKTELNYKNTEPVLDSDGSYFMYSKLR VEKKNWVERNSYSCSVVHEGLHNEIHTTKSFSRTPGK | 798 |
| SM1B329 | HC | QVQLKQSGPGLVQPSQSLSITCTVSGFSITSYGVHWIRQSPG KGLEWLGVIWSGGSTDYNAAFISRLSISKDNSKSQVFFKMN SLQANDTAIYYCATFYYDYDEGFDYWGQGTTLTVSSAKTT APSVYPLAPVCGDTTGSSVTLGCLVKGYFPEPVTLTWNSGS LSSGVHTFPAVLQSDLYTLSSSVTVTSSTWPSQSITCNVAHP ASSTKVDKKIEPRGPTIKPCPPCKCPAPNLLGGPSVFIFPPKIK DVLMISLSPIVTCVVVDVSEDDPDVQISWFVNNVEVHTAQT QTEIREDYNSTLRVVSALPIQHQDWMSGKEFKCKVNNKDLP APIERTISKPKGSVRAPQVYVLPPPEEEMTKKQVTLTCMVTD FMPEDIYVEWTNNGKTELNYKNTEPVLDSDGSYFMYSKLR VEKKNWVERNSYSCSVVHEGLHNEIHTTKSFSRTPGK | 799 |
| SM1B330 | HC | QVQLKQSGPGLVQPSQSLSITCTVSGFSITSYGVHWIRQSPG KGLEWLGVIWSGGSTDYNAAFISRLSISKDNSKSQVFFKMN SLQANDTAIYYCATFYYDYDEGFDYWGQGTTLTVSSAKTT APSVYPLAPVCGDTTGSSVTLGCLVKGYFPEPVTLTWNSGS LSSGVHTFPAVLQSDLYTLSSSVTVTSSTWPSQSITCNVAHP ASSTKVDKKIEPRGPTIKPCPPCKCPAPNLLGGPSVFIFPPKIK DVLMISLSPIVTCVVVDVSEDDPDVQISWFVNNVEVHTAQT QTEIREDYNSTLRVVSALPIQHQDWMSGKEFKCKVNNKDLP APIERTISKPKGSVRAPQVYVLPPPEEEMTKKQVTLTCMVTD | 800 |

TABLE 24-continued

LukE/HlgA Light Chain (LC) and Heavy Chain (HC) Amino Acid Sequences

| mAb/Fab name | region | sequence | SEQ ID NO: |
|---|---|---|---|
| | | FMPEDIYVEWTNNGKTELNYKNTEPVLDSDGSYFMYSKLR VEKKNWVERNSYSCSVVHEGLHNEIHTTKSFSRTPGK | |
| SM1B331 | HC | QVQLKQSGPGLVQPSQSLSITCTVSGFSITSYGVHWIRQSPG KGLEWLGVIWSGGSTDYNAAFISRLSISKDNSKSQVFFKMN SLQANDTAIYYCATFYYDYDEGFDYWGQGTTLTVSSAKTT APSVYPLAPVCGDTTGSSVTLGCLVKGYFPEPVTLTWNSGS LSSGVHTFPAVLQSDLYTLSSSVTVTSSTWPSQSITCNVAHP ASSTKVDKKIEPRGPTIKPCPPCKCPAPNLLGGPSVFIFPPKIK DVLMISLSPIVTCVVVDVSEDDPDVQISWFVNNVEVHTAQT QTEIREDYNSTLRVVSALPIQHQDWMSGKEFKCKVNNKDLP APIERTISKPKGSVRAPQVYVLPPPEEEMTKKQVTLTCMVTD FMPEDIYVEWTNNGKTELNYKNTEPVLDSDGSYFMYSKLR VEKKNWVERNSYSCSVVHEGLHNEIHTTKSFSRTPGK | 801 |
| SM1B332 | HC | QVQLKESGPGLVAPSQSLSITCTVSGLSLTSYGLSWVRQPPG KGLEWLGVIWGDGSTNYHSALISRLSISKDNSKSQVFLKLNS LQSDDTATYYCATRGDYGSYAMDYWGQGTSVTVSSAKTT APSVYPLAPVCGDTTGSSVTLGCLVKGYFPEPVTLTWNSGS LSSGVHTFPAVLQSDLYTLSSSVTVTSSTWPSQSITCNVAHP ASSTKVDKKIEPRGPTIKPCPPCKCPAPNLLGGPSVFIFPPKIK DVLMISLSPIVTCVVVDVSEDDPDVQISWFVNNVEVHTAQT QTEIREDYNSTLRVVSALPIQHQDWMSGKEFKCKVNNKDLP APIERTISKPKGSVRAPQVYVLPPPEEEMTKKQVTLTCMVTD FMPEDIYVEWTNNGKTELNYKNTEPVLDSDGSYFMYSKLR VEKKNWVERNSYSCSVVHEGLHNEIHTTKSFSRTPGK | 802 |
| 5M1B333 | HC | EVQLQQSGAELVRPGASVKLSCTASGFNIKDSLIHWVKQRP EQGLEWIGWIDPEDGETKYAPKFQDKAALTTDTSSNTAYLH LNSLTSEDTAIYYCGRGGLILDYWGQGTTLTVSSAKTTAPSV YPLAPVCGDTTGSSVTLGCLVKGYFPEPVTLTWNSGSLSSG VHTFPAVLQSDLYTLSSSVTVTSSTWPSQSITCNVAHPASST KVDKKIEPRGPTIKPCPPCKCPAPNLLGGPSVFIFPPKIKDVL MISLSPIVTCVVVDVSEDDPDVQISWFVNNVEVHTAQTQTH REDYNSTLRVVSALPIQHQDWMSGKEFKCKVNNKDLPAPIE RTISKPKGSVRAPQVYVLPPPEEEMTKKQVTLTCMVTDFMP EDIYVEWTNNGKTELNYKNTEPVLDSDGSYFMYSKLRVEK KNWVERNSYSCSVVEIEGLHNEIHTTKSFSRTPGK | 803 |
| 5M1B334 | HC | QIQLVQSGPELKKPGETVKISCRSSGYTFTNYGLNWVKQAP GKDLKWMGWLNTYTGEPTYADDFKGRFAFSLETSAGTAYL QINNLKNEDTATYFCSRDYREGDAMDYWSQGTSVTVSSAK TTAPSVYPLAPVCGDTTGSSVTLGCLVKGYFPEPVTLTWNS GSLSSGVHTFPAVLQSDLYTLSSSVTVTSSTWPSQSITCNVA EWASSTKVDKKIEPRGPTIKPCPPCKCPAPNLLGGPSVFIFPPK IKDVLMISLSPIVTCVVVDVSEDDPDVQISWFVNNVEVHTA QTQTHREDYNSTLRVVSALPIQHQDWMSGKEFKCKVNNKD LPAPIERTISKPKGSVRAPQVYVLPPPEEEMTKKQVTLTCMV TDFMPEDIYVEWTNNGKTELNYKNTEPVLDSDGSYFMYSK LRVEKKNWVERNSYSCSVVHEGLHNEIHTTKSFSRTPGK | 804 |
| 5M1B335 | HC | EVQLVESGGGLVKPGGSLKLSCAASGFTFSSYAMSWVRQTP EKRLEWVATISTSGSYTYYRDSVKGRLTISRDNAKNTLYLQ MTSLRSEDTAMYYCTRHGDEIDGFDYWGQGTTLTVSSAKTT APSVYPLAPVCGDTTGSSVTLGCLVKGYFPEPVTLTWNSGS LSSGVHTFPAVLQSDLYTLSSSVTVTSSTWPSQSITCNVAHP ASSTKVDKKIEPRGPTIKPCPPCKCPAPNLLGGPSVFIFPPKIK DVLMISLSPIVTCVVVDVSEDDPDVQISWFVNNVEVHTAQT QTHREDYNSTLRVVSALPIQHQDWMSGKEFKCKVNNKDLP APIERTISKPKGSVRAPQVYVLPPPEEEMTKKQVTLTCMVTD FMPEDIYVEWTNNGKTELNYKNTEPVLDSDGSYFMYSKLR VEKKNWVERNSYSCSVVHEGLHNEIHTTKSFSRTPGK | 805 |
| 5M1B336 | HC | EVQLVESGGGLVKPGGSLKLSCVASGFSFSNYAMSWVRQT PERRLEWVATINSGGSFSFFPDSVKGRFTISRDSAKNTLYLQ MSSLRSDDTAMYYCTRHWDHPWFAYWGQGTLVTVSAAKT TAPSVYPLAPVCGDTTGSSVTLGCLVKGYFPEPVTLTWNSG SLSSGVHTFPAVLQSDLYTLSSSVTVTSSTWPSQSITCNVAHP ASSTKVDKKIEPRGPTIKPCPPCKCPAPNLLGGPSVFIFPPKIK DVLMISLSPIVTCVVVDVSEDDPDVQISWFVNNVEVHTAQT QTHREDYNSTLRVVSALPIQHQDWMSGKEFKCKVNNKDLP APIERTISKPKGSVRAPQVYVLPPPEEEMTKKQVTLTCMVTD FMPEDIYVEWTNNGKTELNYKNTEPVLDSDGSYFMYSKLR VEKKNWVERNSYSCSVVHEGLHNEIHTTKSFSRTPGK | 806 |

TABLE 24-continued

LukE/HlgA Light Chain (LC) and Heavy Chain (HC) Amino Acid Sequences

| mAb/Fab name | region | sequence | SEQ ID NO: |
|---|---|---|---|
| 5M1B337 | HC | EVQLVESGGGLVKPGGSLKLSCVASGFSFSNYAMSWVRQT PERRLEWVATINSGGSFSFFPDSVKGRFTISRDSAKNTLYLQ MSSLRSDDTAMYYCTRHWDHPWFAYWGQGTLVTVSAAKT TAPSVYPLAPVCGDTTGSSVTLGCLVKGYFPEPVTLTWNSG SLSSGVHTFPAVLQSDLYTLSSSVTVTSSTWPSQSITCNVAHP ASSTKVDKKIEPRGPTIKPCPPCKCPAPNLLGGPSVFIFPPKIK DVLMISLSPIVTCVVVDVSEDDPDVQISWFVNNVEVHTAQT QTHREDYNSTLRVVSALPIQHQDWMSGKEFKCKVNNKDLP APIERTISKPKGSVRAPQVYVLPPPEEEMTKKQVTLTCMVTD FMPEDIYVEWTNNGKTELNYKNTEPVLDSDGSYFMYSKLR VEKKNWVERNSYSCSVVHEGLHNEIHTTKSFSRTPGK | 807 |
| 5M1B338 | HC | EVQLVESGGGLVKPGGSLKLSCVASGFSFSNYAMSWVRQT PERRLEWVATINSGGSFSFFPDSVKGRFTISRDSAKNTLYLQ MSSLRSDDTAMYYCTRHWDHPWFAYWGQGTLVTVSAAKT TAPSVYPLAPVCGDTTGSSVTLGCLVKGYFPEPVTLTWNSG SLSSGVHTFPAVLQSDLYTLSSSVTVTSSTWPSQSITCNVAHP ASSTKVDKKIEPRGPTIKPCPPCKCPAPNLLGGPSVFIFPPKIK DVLMISLSPIVTCVVVDVSEDDPDVQISWFVNNVEVHTAQT QTHREDYNSTLRVVSALPIQHQDWMSGKEFKCKVNNKDLP APIERTISKPKGSVRAPQVYVLPPPEEEMTKKQVTLTCMVTD FMPEDIYVEWTNNGKTELNYKNTEPVLDSDGSYFMYSKLR VEKKNWVERNSYSCSVVHEGLHNEIHTTKSFSRTPGK | 808 |
| 5M1B339 | HC | EVQLQQSGAELVRPGASVKLSCTTSGFNIKDSLIYWVKQRP EQGLEWIGWIDPEDGETKFAPRFQDKATITSDTSSNTAYLRL SSLTSKDTAIYYCTRSFGVCWGQGTLVTVSAAKTTAPSVYP LAPVCGDTTGSSVTLGCLVKGYFPEPVTLTWNSGSLSSGVH TFPAVLQSDLYTLSSSVTVTSSTWPSQSITCNVAHPASSTKV DKKIEPRGPTIKPCPPCKCPAPNLLGGPSVFIFPPKIKDVLMIS LSPIVTCVVVDVSEDDPDVQISWFVNNVEVHTAQTQTHRED YNSTLRVVSALPIQHQDWMSGKEFKCKVNNKDLPAPIERTI SKPKGSVRAPQVYVLPPPEEEMTKKQVTLTCMVTDFMPEDI YVEWTNNGKTELNYKNTEPVLDSDGSYFMYSKLRVEKKN WVERNSYSCSVVHEGLHNEIHTTKSFSRTPGK | 809 |
| SM1B340 | HC | EVQLQQSGAELVRPGASVKLSCTTSGFNIKDSLIYWVKQRP EQGLEWIGWIDPEDGETKFAPRFQDKATITSDTSSNTAYLRL SSLTSEDTAIYYCTRSFGVCWGQGTLVTVSAAKTTAPSVYP LAPVCGDTTGSSVTLGCLVKGYFPEPVTLTWNSGSLSSGVH TFPAVLQSDLYTLSSSVTVTSSTWPSQSITCNVAHPASSTKV DKKIEPRGPTIKPCPPCKCPAPNLLGGPSVFIFPPKIKDVLMIS LSPIVTCVVVDVSEDDPDVQISWFVNNVEVHTAQTQTHRED YNSTLRVVSALPIQHQDWMSGKEFKCKVNNKDLPAPIERTI SKPKGSVRAPQVYVLPPPEEEMTKKQVTLTCMVTDFMPEDI YVEWTNNGKTELNYKNTEPVLDSDGSYFMYSKLRVEKKN WVERNSYSCSVVHEGLHNEIHTTKSFSRTPGK | 810 |

TABLE 25

Staphylococcal Protein Sequence

| SEQ ID No. | Type | Species | Description | Sequence |
|---|---|---|---|---|
| 824 | PRT | S. aureus | LukD (E. coli expressed, chemically biotinylated used for binding studies) | MGSSHHHHHHSSGLVPAGSHMLAQHITPVSEKKV DDKITLYKTTATSDNDKLNISQILTFNFIKDKSYDK DTLVLKAAGNINSGYKKPNPKDYNYSQFYWGGK YNVSVSSESNDAVNVVDYAPKNQNEEFQVQQTL GYSYGGDINISNGLSGGLNGSKSFSETINYKQESYR TTIDRKTNHKSIGWGVEAHKIMNNGWGPYGRDS YDPTYGNELFLGGRQSSSNAGQNFLPTHQMPLLA RGNFNPEFISVLSEIKQNDTKKSKIKVTYQREMDR YTNQWNRLHWVGNNYKNQNTVTFTSTYEVDWQ NHTVKLIGTDSKETNPGV |
| 825 | PRT | S. aureus | LukD (S. Aureus expressed, | NSAHHHHHGSAQHITPVSEKKVDDKITLYKTTA TSDNDKLNISQILTFNFIKDKSYDKDTLVLKAAGNI NSGYKKPNPKDYNYSQFYWGGKYNVSVSSESND |

TABLE 25-continued

Staphylococcal Protein Sequence

| SEQ ID No. | Type | Species | Description | Sequence |
|---|---|---|---|---|
| | | | used for neutralization studies) | AVNVVDYAPKNQNEEFQVQQTLGYSYGGDINISN GLSGGLNGSKSFSETINYKQESYRTTIDRKTNEIKSI GWGVEAHKIMNNGWGPYGRDSYDPTYGNELFLG GRQSSSNAGQNFLPTHQMPLLARGNFNPEFISVLS HKQNDTKKSKIKVTYQREMDRYTNQWNRLHWV GNNYKNQNTVTFTSTYEVDWQNHTVKLIGTDSKE TNPGV |
| 826 | PRT | S. aureus | LukE (S. Aureus expressed, used for neutralization studies) | NSAHHHHHHGSNTNIENIGDGAEVIKRTEDVSSKK WGVTQNVQFDFVKDKKYNKDALIVKMQGFINSR TSFSDVKGSGYELTKRMIWPFQYNIGLTTKDPNVS LINYLPKNKIETTDVGQTLGYNIGGNFQSAPSIGGN GSFNYSKTISYTQKSYVSEVDKQNSKSVKWGVKA NEFVTPDGKKSAHDRYLFVQSPNGPTGSAREYFA PDNQLPPLVQSGFNPSFITTLSHEKGSSDTSEFEISY GRNLDITYATLFPRTGIYAERKHNAFVNRNFVVRY EVNWKTHEIKVKGHN |
| 827 | PRT | S. aureus | LukA (E. coli expressed, in vivo biotinylation, used for binding studies) | MNSAHHHHHHHHHGGGLNDIFEAQKIEWHEGS EIKDSQDQNKKEHVDKSQQKDKRNVTNKDKNST APDDIGKNGKITKRTETVYDEKTNILQNLQFDFID DPTYDKNVLLVKKQGSIHSNLKFESHKEEKNSNW LKYPSEYHVDFQVKRNRKTEILDQLPKNKISTAKV DSTFSYSSGGKFDSTKGIGRTSSNSYSKTISYNQQN YDTIASGKNNNWHVHWSVIANDLKYGGEVKNRN DELLFYRNTRIATVENPELSFASKYRYPALVRSGF NPEFLTYLSNEKSNEKTQFEVTYTRNQDILKNRPGI HYAPPILEKNKDGQRLIVTYEVDWKNKTVKVVD KYSDDNKPYKAG |
| 828 | PRT | S. aureus | LukB (E. coli expressed, used for binding studies) | MKINSEIKQVSEKNLDGDTKMYTRTATTSDSQKNI TQSLQFNFLTEPNYDKETVFIKAKGTIGSGLRILDP NGYWNSTLRWPGSYSVSIQNVDDNNNTNVTDFA PKNQDESREVKYTYGYKTGGDFSINRGGLTGNIT KESNYSETISYQQPSYRTLLDQSTSHKGVGWKVE AHLINNMGHDHTRQLTNDSDNRTKSEIFSLTRNG NLWAKDNFTPKDKMPVTVSEGFNPEFLAVMSHD KKDKGKSQFVVHYKRSMDEFKIDWNRHGFWGY WSGENHVDKKEEKLSALYEVDWKTHNVKFVKVL NDNEKK |
| 829 | PRT | S. aureus | LukA (S. aureus expressed, used for neutralization studies) | NSAHEIHHHHGSHKDSQDQNKKEHVDKSQQKDK RNVTNKDKNSTAPDDIGKNGKITKRTETVYDEKT NILQNLQFDFIDDPTYDKNVLLVKKQGSIHSNLKF ESEIKEEKNSNWIKYPSEYHVDFQVKRNRKTEILD QLPKNKISTAKVDSTFSYSSGGKFDSTKGIGRTSSN SYSKTISYNQQNYDTIASGKNNNWHVHWSVIAND LKYGGEVKNRNDELLFYRNTRIATVENPELSFASK YRYPALVRSGFNPEFLTYLSNEKSNEKTQFEVTYT RNQDILKNRPGIHYAPPILEKNKDGQRLIVTYEVD WKNKTVKVVDKYSDDNKPYKEG |
| 830 | PRT | S. aureus | LukB (S. aureus expressed, used for neutralization studies) | KINSEIKQVSEKNLDGDTKMYTRTATTSDSQKNIT QSLQFNFLTEPNYDKETVFIKAKGTIGSGLRILDPN GYWNSTLRWPGSYSVSIQNVDDNNNTNVTDFAP KNQDESREVKYTYGYKTGGDFSINRGGLTGNITK ESNYSETISYQQPSYRTLLDQSTSHKGVGWKVEA EILINNMGHDHTRQLTNDSDNRTKSEIFSLTRNGNL WAKDNFTPKDKMPVTVSEGFNPEFLAVMSHDKK DKGKSQFVVHYKRSMDEFKIDWNRHGFWGYWS GENHVDKKEEKLSALYEVDWKTHNVKFVKVLND NEKK |
| 831 | PRT | Human | CD11bI-domain | MGSSHEIHHHHSSGLVPRGSHMGSNLRQQPQKFPE ALRGCPQEDSDIAFLIDGSGSIIPHDFRRMKEFVST VMEQLKKSKTLFSLMQYSEEFRIHFTFKEFQNNPN PRSLVKPITQLLGRTHTATGIRKVVRELFNITNGAR KNAFKILVVITDGEKFGDPLGYEDVIPEADREGVIR YVIGVGDAFRSEKSRQELNTIASKPPRDHVFQVNN FEALKTIQNQLREKTFAGGGGGGDYKDHDGDYKD HDIDYKDDDDK |
| 832 | PRT | S. aureus | HlgA | NSAHHHHHHGSENKIEDIGQGAEIIKRTQDITSKRL AITQNIQFDFVKDKKYNKDALVVKMQGFISSRTT |

TABLE 25-continued

Staphylococcal Protein Sequence

| SEQ ID No. | Type | Species | Description | Sequence |
|---|---|---|---|---|
| | | | | YSDLKKYPYIKRMIWPFQYNISLKTKDSNVDLINY LPKNKIDSADVSQKLGYNIGGNFQSAPSIGGSGSF NYSKTISYNQKNYVTEVESQNSKGVKWGVKANS FVTPNGQVSAYDQYLFAQDPTGPAARDYFVPDNQ LPPLIQSGFNPSFITTLSHERGKGDKSEFEITYGRN MDATYAYVTRHRLAVDRKEIDAFKNRNVTVKYE VNWKTHEVKIKSITPK |
| 833 | PRT | S. aureus | HlgC | NSAHHHHHHGSANDTEDIGKGSDIEIIKRTEDKTS NKWGVTQNIQFDFVKDKKYNKDALILKMQGFISS RTTYYNYKKTNHVKAMRWPFQYNIGLKTNDKYV SLINYLPKNKIESTNVSQTLGYNIGGNFQSAPSLGG NGSFNYSKSISYTQQNYVSEVEQQNSKSVLWGVK ANSFATESGQKSAFDSDLFVGYKPHSKDPRDYFVP DSELPPLVQSGFNPSFIATVSHEKGSSDTSEFEITYG RNMDVTHAIKRSTHYGNSYLDGEIRVHNAFVNRN YTVKYEVNWKTHEIKVKGQN |

TABLE 26

LukAB Antibody Heavy Chain CDSs

| mAb/Fab name | Construct ID | Heavy Chain CDS | SEQ ID NO: |
|---|---|---|---|
| SM1B105 | pDR000023596 | GAGGTTCAGCTGCAGCAGTCTGGGGCTGAGC TGATGACGCCTGGGGCCTCAGTGAAGATATC CTGCAAGGCTACTGGCTACACATTCAGTACC TTTTGGATAGAGTGGATCAAGCAGAGGCCTG GACATGGCCTTGAGTGGATTGGAGAGATTTT ACCTGGAAGTGGTAGTACTAAGTACAATGAG AAGTTCAAGGGCAAGGCCACATTCACTGCAG ATACATCCTCCAACACAGCCTACATGCAACT CAGCAGCCTGACATCTGAGGACTCTGCCGTC TATTATTGTGCAAGAGGTGGTTACGATGGTA TGGACTACTGGGGTCAAGGAACCTCAGTCAC CGTCTCCTCAGCCAAAACGACACCCCCATCT GTCTATCCACTGGCCCCTGGATCTGCTGCCCA AACTAACTCCATGGTGACCCTGGGATGCCTG GTCAAGGGCTATTTCCCTGAGCCAGTGACAG TGACCTGGAACTCTGGATCCCTGTCCAGCGG TGTGCACACCTTCCCAGCTGTCCTGGAGTCTG ACCTCTACACTCTGAGCAGCTCAGTGACTGT CCCCTCCAGCCCTCGGCCCAGCGAGACCGTC ACCTGCAACGTTGCCCACCCGGCCAGCAGCA CCAAGGTGGACAAGAAAATTGTGCCCAGGG ATTGTGGTTGTAAGCCTTGCATATGTACAGTC CCAGAAGTATCATCTGTCTTCATCTTCCCCCC AAAGCCCAAGGATGTGCTCACCATTACTCTG ACTCCTAAGGTCACGTGTGTTGTGGTAGACA TCAGCAAGGATGATCCCGAGGTCCAGTTCAG CTGGTTTGTAGATGATGTGGAGGTGCACACA GCTCAGACGCAACCCCGGGAGGAGCAGTTCA ACAGCACTTTCCGCTCAGTCAGTGAACTTCC CATCATGCACCAGGACTGGCTCAATGGCAAG GAGTTCAAATGCAGGGTCAACAGTGCAGCTT TCCCTGCCCCCATCGAGAAAACCATCTCCAA AACCAAAGGCAGACCGAAGGCTCCACAGGT GTACACCATTCCACCTCCCAAGGAGCAGATG GCCAAGGATAAAGTCAGTCTGACCTGCATGA TAACAGACTTCTTCCCTGAAGACATTACTGT GGAGTGGCAGTGGAATGGGCAGCCAGCGGA GAACTACAAGAACACTCAGCCCATCATGAAC ACGAATGGCTCTTACTTCGTCTACAGCAAGC TCAATGTGCAGAAGAGCAACTGGGAGGCAG GAAATACTTTCACCTGCTCTGTGTTACATGAG GGCCTGCACAACCACCATACTGAGAAGAGCC TCTCCCACTCTCCTGGTAAA | 834 |
| SM1B106 | pDR000023618 | GAGGTTCAGCTGCAGCAGTCTGGGGCTGAGC TGATGACGCCTGGGGCCTCAGTGAAGATATC | 835 |

TABLE 26-continued

LukAB Antibody Heavy Chain CDSs

| mAb/Fab name | Construct ID | Heavy Chain CDS | SEQ ID NO: |
|---|---|---|---|
| | | CTGCAAGGCTACTGGCTACACATTCAGTACC<br>TTTTGGATAGAGTGGATCAAGCAGAGGCCTG<br>GACATGGCCTTGAGTGGATTGGAGAGATTTT<br>ACCTGGAAGTGGTAGTACTAAGTACAATGAG<br>AAGTTCAAGGGCAAGGCCACATTCACTGCAG<br>ATACATCCTCCAACACAGCCTACATGCAACT<br>CAGCAGCCTGTCATCTGAGGACTCTGCCGTC<br>TATTATTGTGCAAGAGGTGGTTACGATGGTA<br>TGGACTACTGGGGTCAAGGAACCTCAGTCAC<br>CGTCTCCTCAGCCAAAACGACACCCCCATCT<br>GTCTATCCACTGGCCCCTGGATCTGCTGCCCA<br>AACTAACTCCATGGTGACCCTGGGATGCCTG<br>GTCAAGGGCTATTTCCCTGAGCCAGTGACAG<br>TGACCTGGAACTCTGGATCCCTGTCCAGCGG<br>TGTGCACACCTTCCCAGCTGTCCTGGAGTCTG<br>ACCTCTACACTCTGAGCAGCTCAGTGACTGT<br>CCCCTCCAGCCCTCGGCCCAGCGAGACCGTC<br>ACCTGCAACGTTGCCCACCCGGCCAGCAGCA<br>CCAAGGTGGACAAGAAAATTGTGCCCAGGG<br>ATTGTGGTTGTAAGCCTTGCATATGTACAGTC<br>CCAGAAGTATCATCTGTCTTCATCTTCCCCCC<br>AAAGCCCAAGGATGTGCTCACCATTACTCTG<br>ACTCCTAAGGTCACGTGTGTTGTGGTAGACA<br>TCAGCAAGGATGATCCCGAGGTCCAGTTCAG<br>CTGGTTTGTAGATGATGTGGAGGTGCACACA<br>GCTCAGACGCAACCCCGGGAGGAGCAGTTCA<br>ACAGCACTTTCCGCTCAGTCAGTGAACTTCC<br>CATCATGCACCAGGACTGGCTCAATGGCAAG<br>GAGTTCAAATGCAGGGTCAACAGTGCAGCTT<br>TCCCTGCCCCCATCGAGAAAACCATCTCCAA<br>AACCAAAGGCAGACCGAAGGCTCCACAGGT<br>GTACACCATTCCACCTCCCAAGGAGCAGATG<br>GCCAAGGATAAAGTCAGTCTGACCTGCATGA<br>TAACAGACTTCTTCCCTGAAGACATTACTGT<br>GGAGTGGCAGTGGAATGGGCAGCCAGCGGA<br>GAACTACAAGAACACTCAGCCCATCATGAAC<br>ACGAATGGCTCTTACTTCGTCTACAGCAAGC<br>TCAATGTGCAGAAGAGCAACTGGGAGGCAG<br>GAAATACTTTCACCTGCTCTGTGTTACATGAG<br>GGCCTGCACAACCACCATACTGAGAAGAGCC<br>TCTCCCACTCTCCTGGTAAA | |
| SM1B107 | pDR000023619 | GAGGTTCAGCTGCAGCAGTCTGAGGCTGAGC<br>TGATGACGCCTGGGGCCTCAGTGAAGATATC<br>CTGCAAGGCTACTGGCTACACATTCAGTACC<br>TTTTGGATAGAGTGGATCAAGCAGAGGCCTG<br>GACATGGCCTTGAGTGGATTGGAGAGATTTT<br>ACCTGGAAGTGGTAGTACTAAGTACAATGAG<br>AAGTTCAAGGGCAAGGCCACATTCACTGCAG<br>ATACATCCTCCAACACAGCCTACATGCAACT<br>CAGCAGCCTGACATCTGAGGACTCTGCCGTC<br>TATTATTGTGCAAGAGGTGGTTACGATGGTA<br>TGGACTACTGGGGTCAAGGAACCTCAGTCAC<br>CGTCTCCTCAGCCAAAACGACACCCCCATCT<br>GTCTATCCACTGGCCCCTGGATCTGCTGCCCA<br>AACTAACTCCATGGTGACCCTGGGATGCCTG<br>GTCAAGGGCTATTTCCCTGAGCCAGTGACAG<br>TGACCTGGAACTCTGGATCCCTGTCCAGCGG<br>TGTGCACACCTTCCCAGCTGTCCTGGAGTCTG<br>ACCTCTACACTCTGAGCAGCTCAGTGACTGT<br>CCCCTCCAGCCCTCGGCCCAGCGAGACCGTC<br>ACCTGCAACGTTGCCCACCCGGCCAGCAGCA<br>CCAAGGTGGACAAGAAAATTGTGCCCAGGG<br>ATTGTGGTTGTAAGCCTTGCATATGTACAGTC<br>CCAGAAGTATCATCTGTCTTCATCTTCCCCCC<br>AAAGCCCAAGGATGTGCTCACCATTACTCTG<br>ACTCCTAAGGTCACGTGTGTTGTGGTAGACA<br>TCAGCAAGGATGATCCCGAGGTCCAGTTCAG<br>CTGGTTTGTAGATGATGTGGAGGTGCACACA<br>GCTCAGACGCAACCCCGGGAGGAGCAGTTCA<br>ACAGCACTTTCCGCTCAGTCAGTGAACTTCC<br>CATCATGCACCAGGACTGGCTCAATGGCAAG<br>GAGTTCAAATGCAGGGTCAACAGTGCAGCTT<br>TCCCTGCCCCCATCGAGAAAACCATCTCCAA<br>AACCAAAGGCAGACCGAAGGCTCCACAGGT | 836 |

TABLE 26-continued

LukAB Antibody Heavy Chain CDSs

| mAb/Fab name | Construct ID | Heavy Chain CDS | SEQ ID NO: |
| --- | --- | --- | --- |
| | | GTACACCATTCCACCTCCCAAGGAGCAGATG GCCAAGGATAAAGTCAGTCTGACCTGCATGA TAACAGACTTCTTCCCTGAAGACATTACTGT GGAGTGGCAGTGGAATGGGCAGCCAGCGGA GAACTACAAGAACACTCAGCCCATCATGAAC ACGAATGGCTCTTACTTCGTCTACAGCAAGC TCAATGTGCAGAAGAGCAACTGGGAGGCAG GAAATACTTTCACCTGCTCTGTGTTACATGAG GGCCTGCACAACCACCATACTGAGAAGAGCC TCTCCCACTCTCCTGGTAAA | |
| SM1B108 | pDR000023620 | GAGGTTCAGCTGCAGCAGTCTGGGGCTGAGC TGGTGAAGCCTGGGGCCTCAGTGAAGATTTC CTGCAAGGCTTCTGGCTATGCATTCAGTAGC TCCTGGATGAACTGGGTGAAGCAGAGGCCTG GAAAGGGTCTTGAGTGGATTGGACGGATTTA TCCTGGAGATGGAGATACTAACTACCATGGG AAGTTCAAGGGCAAGGCCACACTGACTGCAG ACAAATCCTCCAGCACAGCCTACATGCAACT CAGCAGCCTGACATCTGAGGACTCTGCGGTC TACTTCTGTGCAAGAAGGAACTATGATGGTT ACCACTATGGTATGGACTACTGGGGTCAAGG AACCTCAGTCACCGTCTCCTCAGCCAAAACG ACACCCCCATCTGTCTATCCACTGGCCCCTGG ATCTGCTGCCCAAACTAACTCCATGGTGACC CTGGGATGCCTGGTCAAGGGCTATTTCCCTG AGCCAGTGACAGTGACCTGGAACTCTGGATC CCTGTCCAGCGGTGTGCACACCTTCCCAGCT GTCCTGGAGTCTGACCTCTACACTCTGAGCA GCTCAGTGACTGTCCCCTCCAGCCCTCGGCC CAGCGAGACCGTCACCTGCAACGTTGCCCAC CCGGCCAGCAGCACCAAGGTGGACAAGAAA ATTGTGCCCAGGGATTGTGGTTGTAAGCCTT GCATATGTACAGTCCCAGAAGTATCATCTGT CTTCATCTTCCCCCCAAAGCCCAAGGATGTG CTCACCATTACTCTGACTCCTAAGGTCACGTG TGTTGTGGTAGACATCAGCAAGGATGATCCC GAGGTCCAGTTCAGCTGGTTTGTAGATGATG TGGAGGTGCACACAGCTCAGACGCAACCCCG GGAGGAGCAGTTCAACAGCACTTTCCGCTCA GTCAGTGAACTTCCCATCATGCACCAGGACT GGCTCAATGGCAAGGAGTTCAAATGCAGGGT CAACAGTGCAGCTTTCCCTGCCCCCATCGAG AAAACCATCTCCAAAACCAAAGGCAGACCG AAGGCTCCACAGGTGTACACCATTCCACCTC CCAAGGAGCAGATGGCCAAGGATAAAGTCA GTCTGACCTGCATGATAACAGACTTCTTCCCT GAAGACATTACTGTGGAGTGGCAGTGGAATG GGCAGCCAGCGGAGAACTACAAGAACACTC AGCCCATCATGAACACGAATGGCTCTTACTT CGTCTACAGCAAGCTCAATGTGCAGAAGAGC AACTGGGAGGCAGGAAATACTTTCACCTGCT CTGTGTTACATGAGGGCCTGCACAACCACCA TACTGAGAAGAGCCTCTCCCACTCTCCTGGT AAA | 837 |
| SM1B109 | pDR000023596 | GAGGTTCAGCTGCAGCAGTCTGGGGCTGAGC TGATGACGCCTGGGGCCTCAGTGAAGATATC CTGCAAGGCTACTGGCTACACATTCAGTACC TTTTGGATAGAGTGGATCAAGCAGAGGCCTG GACATGGCCTTGAGTGGATTGGAGAGATTTT ACCTGGAAGTGGTAGTACTAAGTACAATGAG AAGTTCAAGGGCAAGGCCACATTCACTGCAG ATACATCCTCCAACACAGCCTACATGCAACT CAGCAGCCTGACATCTGAGGACTCTGCCGTC TATTATTGTGCAAGAGGTGGTTACGATGGTA TGGACTACTGGGGTCAAGGAACCTCAGTCAC CGTCTCCTCAGCCAAAACGACACCCCCATCT GTCTATCCACTGGCCCCTGGATCTGCTGCCCA AACTAACTCCATGGTGACCCTGGGATGCCTG GTCAAGGGCTATTTCCCTGAGCCAGTGACAG TGACCTGGAACTCTGGATCCCTGTCCAGCGG TGTGCACACCTTCCCAGCTGTCCTGGAGTCTG ACCTCTACACTCTGAGCAGCTCAGTGACTGT CCCCTCCAGCCCTCGGCCCAGCGAGACCGTC | 838 |

TABLE 26-continued

LukAB Antibody Heavy Chain CDSs

| mAb/Fab name | Construct ID | Heavy Chain CDS | SEQ ID NO: |
|---|---|---|---|
| | | ACCTGCAACGTTGCCCACCCGGCCAGCAGCA CCAAGGTGGACAAGAAAATTGTGCCCAGGG ATTGTGGTTGTAAGCCTTGCATATGTACAGTC CCAGAAGTATCATCTGTCTTCATCTTCCCCCC AAAGCCCAAGGATGTGCTCACCATTACTCTG ACTCCTAAGGTCACGTGTGTTGTGGTAGACA TCAGCAAGGATGATCCCGAGGTCCAGTTCAG CTGGTTTGTAGATGATGTGGAGGTGCACACA GCTCAGACGCAACCCCGGGAGGAGCAGTTCA ACAGCACTTTCCGCTCAGTCAGTGAACTTCC CATCATGCACCAGGACTGGCTCAATGGCAAG GAGTTCAAATGCAGGGTCAACAGTGCAGCTT TCCCTGCCCCCATCGAGAAAACCATCTCCAA AACCAAAGGCAGACCGAAGGCTCCACAGGT GTACACCATTCCACCTCCCAAGGAGCAGATG GCCAAGGATAAAGTCAGTCTGACCTGCATGA TAACAGACTTCTTCCCTGAAGACATTACTGT GGAGTGGCAGTGGAATGGGCAGCCAGCGGA GAACTACAAGAACACTCAGCCCATCATGAAC ACGAATGGCTCTTACTTCGTCTACAGCAAGC TCAATGTGCAGAAGAGCAACTGGGAGGCAG GAAATACTTTCACCTGCTCTGTGTTACATGAG GGCCTGCACAACCACCATACTGAGAAGAGCC TCTCCCACTCTCCTGGTAAA | |
| SM1B110 | pDR000023622 | GAGGTTCAGCTGCAGCAGTCTGGGGCTGAGC TGGTCAAGCCTGGGACTTCAGTGAAGATGTC CTGCAAGGCTTCTGGCTACACCTTCACCAGC TACTGGATGCACTGGGTGAAACTTAGGCCTG GACAAGGCCTTGAGTGGATCGGAGTGATTGA TCCTTCTGATAGTTATACTAACTATAATCAAA AGTTCAAGGGCAGGGCCACATTGACTGGAGA CACATCCTCCAGCACAGCCTACATGCAGCTC AGCAGCCTGACATCTGAGGACTCTGCGGTCT ATTACTGTACAAGAGCAGCATATGATAACTC GTACTACTTTGACTACTGGGGCCAAGGCACC ACTCTCACAGTCTCCTCAGCCAAAACGACAC CCCCATCTGTCTATCCACTGGCCCCTGGATCT GCTGCCCAAACTAACTCCATGGTGACCCTGG GATGCCTGGTCAAGGGCTATTTCCCTGAGCC AGTGACAGTGACCTGGAACTCTGGATCCCTG TCCAGCGGTGTGCACACCTTCCCAGCTGTCCT GGAGTCTGACCTCTACACTCTGAGCAGCTCA GTGACTGTCCCCTCCAGCCCTCGGCCCAGCG AGACCGTCACCTGCAACGTTGCCCACCCGGC CAGCAGCACCAAGGTGGACAAGAAAATTGT GCCCAGGGATTGTGGTTGTAAGCCTTGCATA TGTACAGTCCCAGAAGTATCATCTGTCTTCAT CTTCCCCCCAAAGCCCAAGGATGTGCTCACC ATTACTCTGACTCCTAAGGTCACGTGTGTTGT GGTAGACATCAGCAAGGATGATCCCGAGGTC CAGTTCAGCTGGTTTGTAGATGATGTGGAGG TGCACACAGCTCAGACGCAACCCCGGGAGG AGCAGTTCAACAGCACTTTCCGCTCAGTCAG TGAACTTCCCATCATGCACCAGGACTGGCTC AATGGCAAGGAGTTCAAATGCAGGGTCAAC AGTGCAGCTTTCCCTGCCCCCATCGAGAAAA CCATCTCCAAAACCAAAGGCAGACCGAAGG CTCCACAGGTGTACACCATTCCACCTCCCAA GGAGCAGATGGCCAAGGATAAAGTCAGTCT GACCTGCATGATAACAGACTTCTTCCCTGAA GACATTACTGTGGAGTGGCAGTGGAATGGGC AGCCAGCGGAGAACTACAAGAACACTCAGC CCATCATGAACACGAATGGCTCTTACTTCGT CTACAGCAAGCTCAATGTGCAGAAGAGCAAC TGGGAGGCAGGAAATACTTTCACCTGCTCTG TGTTACATGAGGGCCTGCACAACCACCATAC TGAGAAGAGCCTCTCCCACTCTCCTGGTAAA | 839 |
| SM1B111 | pDR000023624 | GAGGTTCAGCTGCAGCAGTCTGGGGCTGAGC TGGTGAAGCCTGGGGCCTCAGTGAAGATTTC CTGCAAGGCTTCTGGCTATGCATTCAGTAGTT CCTGGATGAACTGGTTGAAGCAGAGGCCTGG AAAGGGTCTTGAGTGGATTGGACGGATTTAT CCTGGAGATGGAGATACTAATTACAATGGGA | 840 |

TABLE 26-continued

LukAB Antibody Heavy Chain CDSs

| mAb/Fab name | Construct ID | Heavy Chain CDS | SEQ ID NO: |
|---|---|---|---|
| | | AGTTCAAGGGCAAGGCCACACTGACTGCAGA CAAGTCCTCCAGTACAGCCTACATGCAACTC AGCAGCCTGACATCTGAGGACTCTGCGGTCT ACTTCTGTGCAAGATACGGCTATGATTACGA CGGGGAATATTACTATGCTATGGACTACTGG GGTCAAGGAACCTCAGTCACCGTCTCCTCAG CCAAAACGACACCCCCATCTGTCTATCCACT GGCCCCTGGATCTGCTGCCCAAACTAACTCC ATGGTGACCCTGGGATGCCTGGTCAAGGGCT ATTTCCCTGAGCCAGTGACAGTGACCTGGAA CTCTGGATCCCTGTCCAGCGGTGTGCACACC TTCCCAGCTGTCCTGGAGTCTGACCTCTACAC TCTGAGCAGCTCAGTGACTGTCCCCTCCAGC CCTCGGCCCAGCGAGACCGTCACCTGCAACG TTGCCCACCCGGCCAGCAGCACCAAGGTGGA CAAGAAAATTGTGCCCAGGGATTGTGGTTGT AAGCCTTGCATATGTACAGTCCCAGAAGTAT CATCTGTCTTCATCTTCCCCCAAAGCCCAAG GATGTGCTCACCATTACTCTGACTCCTAAGGT CAC GTGTGTTGTGGTAGACATCAGCAAGGAT GATCCCGAGGTCCAGTTCAGCTGGTTTGTAG ATGATGTGGAGGTGCACACAGCTCAGAC GCA ACCCCGGGAGGAGCAGTTCAACAGCACTTTC CGCTCAGTCAGTGAACTTCCCATCATGCACC AGGACTGGCTCAATGGCAAGGAGTTCAAATG CAGGGTCAACAGTGCAGCTTTCCCTGCCCCC ATCGAGAAAACCATCTCCAAAACCAAAGGC AGACCGAAGGCTCCACAGGTGTACACCATTC CACCTCCCAAGGAGCAGATGGCCAAGGATA AAGTCAGTCTGACCTGCATGATAACAGACTT CTTCCCTGAAGACATTACTGTGGAGTGGCAG TGGAATGGGCAGCCAGCGGAGAACTACAAG AACACTCAGCCCATCATGAACACGAATGGCT CTTACTTCGTCTACAGCAAGCTCAATGTGCA GAAGAGCAACTGGGAGGCAGGAAATACTTT CACCTGCTCTGTGTTACATGAGGGCCTGCAC AACCACCATACTGAGAAGAGCCTCTCCCACT CTCCTGGTAAA | |
| SM1B112 | pDR000023623 | CAGGTGCAGCTGAAGGAGTCAGGACCTGAA CTGAAGAAGCCTGGAGAGACAGTCAGGATCT CCTGCAAGGCTTCTGGGTATACTTTCACAAA TTATGGAATGAACTGGGTGAAGCAGACTCCA GGAAAGGGTTTAAAGTGGATAGACTGGTTAA AGTCCTACACTGGAGAGCCAACACATACTGG TGACTTCAAGGGACGGTTTGACCTCTCTTTGG AAACCTCTGCCAACACTGCCTATTTGCAGAT CAACAACCTCAAAAATGAGGACACGGCTAC ATATTTCTGTGCAAGAGGGTCCCTCTTTGGTT TGGACTACTGGGGTCAAGGAACCTCAGTCAC CGTCTCCTCAGCCAAAACGACACCCCCATCT GTCTATCCACTGGCCCCTGGATCTGCTGCCCA AACTAACTCCATGGTGACCCTGGGATGCCTG GTCAAGGGCTATTTCCCTGAGCCAGTGACAG TGACCTGGAACTCTGGATCCCTGTCCAGCGG TGTGCACACCTTCCCAGCTGTCCTGGAGTCTG ACCTCTACACTCTGAGCAGCTCAGTGACTGT CCCCTCCAGCCCTCGGCCCAGCGAGACCGTC ACCTGCAACGTTGCCCACCCGGCCAGCAGCA CCAAGGTGGACAAGAAAATTGTGCCCAGGG ATTGTGGTTGTAAGCCTTGCATATGTACAGTC CCAGAAGTATCATCTGTCTTCATCTTCCCCCC AAAGCCCAAGGATGTGCTCACCATTACTCTG ACTCCTAAGGTCACGTGTGTTGTGGTAGACA TCAGCAAGGATGATCCCGAGGTCCAGTTCAG CTGGTTTGTAGATGATGTGGAGGTGCACACA GCTCAGACGCAACCCCGGGAGGAGCAGTTCA ACAGCACTTTCCGCTCAGTCAGTGAACTTCC CATCATGCACCAGGACTGGCTCAATGGCAAG GAGTTCAAATGCAGGGTCAACAGTGCAGCTT TCCCTGCCCCCATCGAGAAAACCATCTCCAA AACCAAAGGCAGACCGAAGGCTCCACAGGT GTACACCATTCCACCTCCCAAGGAGCAGATG GCCAAGGATAAAGTCAGTCTGACCTGCATGA TAACAGACTTCTTCCCTGAAGACATTACTGT | 841 |

TABLE 26-continued

LukAB Antibody Heavy Chain CDSs

| mAb/Fab name | Construct ID | Heavy Chain CDS | SEQ ID NO: |
|---|---|---|---|
| | | GGAGTGGCAGTGGAATGGGCAGCCAGCGGA<br>GAACTACAAGAACACTCAGCCCATCATGAAC<br>ACGAATGGCTCTTACTTCGTCTACAGCAAGC<br>TCAATGTGCAGAAGAGCAACTGGGAGGCAG<br>GAAATACTTTCACCTGCTCTGTGTTACATGAG<br>GGCCTGCACAACCACCATACTGAGAAGAGCC<br>TCTCCCACTCTCCTGGTAAA | |
| 5M1B243 | pDR000030109 | GAAGTCCAGCTGCAGCAGAGCGGAGCCGAG<br>CTGGTCAAAAGCGGAGCCAGCGTGAAGCTG<br>AGCTGCACCGCCAGCGGCTTCAACATCAAGG<br>ACTACTACATGCACTGGGTCAAGCAGCGGCC<br>CGAGCAGGGCCTGGAATGGATCGGAAGAAT<br>CGACCCCGCCAACGGCAACACCAAATACGAC<br>CCCAAGTTCCAGGACAAGGCCACCATCACCA<br>GCGACACCAGCAGCAACACCGCCTACCTGCA<br>GCTGAGCAGCCTGACCAGCGAGGACACCGCC<br>GTGTACTACTGCGCCGAGGGCGATTACGTGC<br>CCGGCTACTTTGATGTGTGGGGAGCCGGCAC<br>CACCGTGACCGTGTCATCTGCCAAAACAACA<br>GCACCAAGTGTCTATCCACTGGCCCCTGTGT<br>GTGGAGATACAACTGGCTCCTCGGTGACTCT<br>AGGATGCCTGGTCAAGGGTTATTTCCCTGAG<br>CCAGTGACCTTGACCTGGAACTCTGGATCCC<br>TGTCCAGTGGTGTGCACACCTTCCCAGCTGTC<br>CTGCAGTCTGACCTCTACACCCTCAGCAGCT<br>CAGTGACTGTAACCTCGAGCACCTGGCCCAG<br>CCAGTCCATCACCTGCAATGTGGCCCACCCG<br>GCAAGCAGCACCAAGGTGGACAAGAAAATT<br>GAGCCCAGAGGGCCCACAATCAAGCCCTGTC<br>CTCCATGCAAATGCCCAGCACCTAACCTCTT<br>GGGTGGACCATCCGTCTTCATCTTCCCTCCAA<br>AGATCAAGGATGTACTCATGATCTCCCTGAG<br>CCCCATAGTCACATGTGTGGTGGTGGATGTG<br>AGCGAGGATGACCCAGATGTCCAGATCAGCT<br>GGTTTGTGAACAACGTGGAAGTACACACAGC<br>TCAGACACAAACCCATAGAGAGGATTACAAC<br>AGTACTCTCCGGGTGGTCAGTGCCCTCCCCA<br>TCCAGCACCAGGACTGGATGAGTGGCAAGG<br>AGTTCAAATGCAAGGTCAACAACAAAGACCT<br>CCCAGCGCCCATCGAGAGAACCATCTCAAAA<br>CCCAAAGGGTCAGTAAGAGCTCCACAGGTAT<br>ATGTCTTGCCTCCACCAGAAGAAGAGATGAC<br>TAAGAAACAGGTCACTCTGACCTGCATGGTC<br>ACAGACTTCATGCCTGAAGACATTTACGTGG<br>AGTGGACCAACAACGGGAAAACAGAGCTAA<br>ACTACAAGAACACTGAACCAGTCCTGGACTC<br>TGATGGTTCTTACTTCATGTACAGCAAGCTG<br>AGAGTGGAAAAGAAGAACTGGGTGGAAAGA<br>AATAGCTACTCCTGTTCAGTGGTCCACGAGG<br>GTCTGCACAATCACCACACGACTAAGAGCTT<br>CTCCCGGACTCCGGGTAAA | 842 |
| SM1B244 | pDR000030218 | GAGGTCCAGCTGCAGGAATCTGGCCCTAGCC<br>TGGTCAAGCCCAGCCAGACCCTGAGCCTGAC<br>CTGTAGCGTGACCGGCGACAGCATCACCAGC<br>GACTACTGGAACTGGATCCGGAAGTTCCCCG<br>GCAACAAGCTCGAGTACATGGGCTACATCAG<br>CTACAGCGGCAGCACCTACTACAACCCCAGC<br>CTGAAGTCCCGGATCTCCATCACCCGGGACA<br>CCAGCAAGAACCAGTACTATCTGCAGCTGAA<br>CAGCGTGACCACCGAGGACACCGCCACCTAC<br>TATTGTGCCGGCGACTACGGCAGCCCCTACG<br>CCATGGATTATTGGGGCCAGGGCACCTCCGT<br>GACCGTGTCTAGTGCCAAAACAACAGCACCA<br>AGTGTCTATCCACTGGCCCCTGTGTGTGGAG<br>ATACAACTGGCTCCTCGGTGACTCTAGGATG<br>CCTGGTCAAGGGTTATTTCCCTGAGCCAGTG<br>ACCTTGACCTGGAACTCTGGATCCCTGTCCA<br>GTGGTGTGCACACCTTCCCAGCTGTCCTGCA<br>GTCTGACCTCTACACCCTCAGCAGCTCAGTG<br>ACTGTAACCTCGAGCACCTGGCCCAGCCAGT<br>CCATCACCTGCAATGTGGCCCACCCGGCAAG<br>CAGCACCAAGGTGGACAAGAAAATTGAGCC<br>CAGAGGGCCCACAATCAAGCCCTGTCCTCCA | 843 |

TABLE 26-continued

LukAB Antibody Heavy Chain CDSs

| mAb/Fab name | Construct ID | Heavy Chain CDS | SEQ ID NO: |
|---|---|---|---|
| | | TGCAAATGCCCAGCACCTAACCTCTTGGGTG<br>GACCATCCGTCTTCATCTTCCCTCCAAAGATC<br>AAGGATGTACTCATGATCTCCCTGAGCCCCA<br>TAGTCACATGTGTGGTGGTGGATGTGAGCGA<br>GGATGACCCAGATGTCCAGATCAGCTGGTTT<br>GTGAACAACGTGGAAGTACACACAGCTCAG<br>ACACAAACCCATAGAGAGGATTACAACAGT<br>ACTCTCCGGGTGGTCAGTGCCCTCCCCATCC<br>AGCACCAGGACTGGATGAGTGGCAAGGAGT<br>TCAAATGCAAGGTCAACAACAAAGACCTCCC<br>AGCGCCCATCGAGAGAACCATCTCAAAACCC<br>AAAGGGTCAGTAAGAGCTCCACAGGTATATG<br>TCTTGCCTCCACCAGAAGAAGAGATGACTAA<br>GAAACAGGTCACTCTGACCTGCATGGTCACA<br>GACTTCATGCCTGAAGACATTTACGTGGAGT<br>GGACCAACAACGGGAAAACAGAGCTAAACT<br>ACAAGAACACTGAACCAGTCCTGGACTCTGA<br>TGGTTCTTACTTCATGTACAGCAAGCTGAGA<br>GTGGAAAAGAAGAACTGGGTGGAAAGAAAT<br>AGCTACTCCTGTTCAGTGGTCCACGAGGGTC<br>TGCACAATCACCACACGACTAAGAGCTTCTC<br>CCGGACTCCGGGTAAA | |
| SM1B245 | pDR000030219 | CAGGTCCAGCTGCAGCAGTCTGGCGCTGAAC<br>TGGCCAAGCCTGGGGCCAGCGTGAAGATGA<br>GCTGCAAGAGCAGCGGCTACACCTTCAGCAC<br>CTACTGGATGCACTGGGTCAAGCAGAGGCCA<br>GGCCAGGGCCTGGAATGGATCGGCTACATCA<br>ACCCCAACACCGGCTACACAGAGTACAACCA<br>GAAGTTCAAGGACACCGCCACCCTGACCGCC<br>GACAAGTCTAGCAGCACCGCCTACATGCAGC<br>TGAGCAGCCTGACCAGCGAGGACAGCGCCGT<br>GTACTATTGTGCCAGAGGCGGCAGCAAGGCC<br>TTCCCCTACTACGCCATGGACTATTGGGGCC<br>AGGGCACCAGCGTGACCGTGTCTAGTGCCAA<br>AACAACAGCACCAAGTGTCTATCCACTGGCC<br>CCTGTGTGTGGAGATACAACTGGCTCCTCGG<br>TGACTCTAGGATGCCTGGTCAAGGGTTATTT<br>CCCTGAGCCAGTGACCTTGACCTGGAACTCT<br>GGATCCCTGTCCAGTGGTGTGCACACCTTCC<br>CAGCTGTCCTGCAGTCTGACCTCTACACCCTC<br>AGCAGCTCAGTGACTGTAACCTCGAGCACCT<br>GGCCCAGCCAGTCCATCACCTGCAATGTGGC<br>CCACCCGGCAAGCAGCACCAAGGTGGACAA<br>GAAAATTGAGCCCAGAGGGCCCACAATCAA<br>GCCCTGTCCTCCATGCAAATGCCCAGCACCT<br>AACCTCTTGGGTGGACCATCCGTCTTCATCTT<br>CCCTCCAAAGATCAAGGATGTACTCATGATC<br>TCCCTGAGCCCCATAGTCACATGTGTGGTGG<br>TGGATGTGAGCGAGGATGACCCAGATGTCCA<br>GATCAGCTGGTTTGTGAACAACGTGGAAGTA<br>CACACAGCTCAGACACAAACCCATAGAGAG<br>GATTACAACAGTACTCTCCGGGTGGTCAGTG<br>CCCTCCCCATCCAGCACCAGGACTGGATGAG<br>TGGCAAGGAGTTCAAATGCAAGGTCAACAAC<br>AAAGACCTCCCAGCGCCCATCGAGAGAACCA<br>TCTCAAAACCCAAAGGGTCAGTAAGAGCTCC<br>ACAGGTATATGTCTTGCCTCCACCAGAAGAA<br>GAGATGACTAAGAAACAGGTCACTCTGACCT<br>GCATGGTCACAGACTTCATGCCTGAAGACAT<br>TTACGTGGAGTGGACCAACAACGGGAAAAC<br>AGAGCTAAACTACAAGAACACTGAACCAGTC<br>CTGGACTCTGATGGTTCTTACTTCATGTACAG<br>CAAGCTGAGAGTGGAAAAGAAGAACTGGGT<br>GGAAAGAAATAGCTACTCCTGTTCAGTGGTC<br>CACGAGGGTCTGCACAATCACCACACGACTA<br>AGAGCTTCTCCCGGACTCCGGGTAAA | 844 |
| SM1B246 | pDR000030220 | GAGATCCAGCTGCAGCAGTCTGGCCCTGAGC<br>TGGTCAAGCCTGGGGCCAGCGTGAAGATGAG<br>CTGCAAGGCCAGCGGCTACAGCTTCACCGGC<br>TACAACATGCACTGGGTCAAGCAGAGCCACG<br>GCAAGAGCCTGGAATGGATCGGCTACATCGA<br>CCCCTACAACGGGGCCACCAGCCACAACCAG<br>AAGTTCAAGGGCAAGGCCACCCTGACCGTGG | 845 |

TABLE 26-continued

LukAB Antibody Heavy Chain CDSs

| mAb/Fab name | Construct ID | Heavy Chain CDS | SEQ ID NO: |
| --- | --- | --- | --- |
| | | AAAAGAGCAGCAGCACCGCCTACATGCAGCT<br>GAACAGCCTGACCAGCGAGGACAGCGCCGT<br>GTACTACTGCGCCAGAGGCCTGTACGGCGAC<br>TATTGGTACGCCTATTGGGGCCAGGGCACCC<br>TGGTCACCGTGTCTAGTGCCAAAACAACAGC<br>ACCAAGTGTCTATCCACTGGCCCCTGTGTGT<br>GGAGATACAACTGGCTCCTCGGTGACTCTAG<br>GATGCCTGGTCAAGGGTTATTTCCCTGAGCC<br>AGTGACCTTGACCTGGAACTCTGGATCCCTG<br>TCCAGTGGTGTGCACACCTTCCCAGCTGTCCT<br>GCAGTCTGACCTCTACACCCTCAGCAGCTCA<br>GTGACTGTAACCTCGAGCACCTGGCCCAGCC<br>AGTCCATCACCTGCAATGTGGCCCACCCGGC<br>AAGCAGCACCAAGGTGGACAAGAAAATTGA<br>GCCCAGAGGGCCCACAATCAAGCCCTGTCCT<br>CCATGCAAATGCCCAGCACCTAACCTCTTGG<br>GTGGACCATCCGTCTTCATCTTCCCTCCAAAG<br>ATCAAGGATGTACTCATGATCTCCCTGAGCC<br>CCATAGTCACATGTGTGGTGGTGGATGTGAG<br>CGAGGATGACCCAGATGTCCAGATCAGCTGG<br>TTTGTGAACAACGTGGAAGTACACACAGCTC<br>AGACACAAACCCATAGAGAGGATTACAACA<br>GTACTCTCCGGGTGGTCAGTGCCCTCCCCATC<br>CAGCACCAGGACTGGATGAGTGGCAAGGAG<br>TTCAAATGCAAGGTCAACAACAAAGACCTCC<br>CAGCGCCCATCGAGAGAACCATCTCAAAACC<br>CAAAGGGTCAGTAAGAGCTCCACAGGTATAT<br>GTCTTGCCTCCACCAGAAGAAGAGATGACTA<br>AGAAACAGGTCACTCTGACCTGCATGGTCAC<br>AGACTTCATGCCTGAAGACATTTACGTGGAG<br>TGGACCAACAACGGGAAAACAGAGCTAAAC<br>TACAAGAACACTGAACCAGTCCTGGACTCTG<br>ATGGTTCTTACTTCATGTACAGCAAGCTGAG<br>AGTGGAAAAGAAGAACTGGGTGGAAAGAAA<br>TAGCTACTCCTGTTCAGTGGTCCACGAGGGT<br>CTGCACAATCACCACACGACTAAGAGCTTCT<br>CCCGGACTCCGGGTAAA | |
| 5M1B247 | pDR000030221 | GAGGTGCAGCTGGTGGAATCTGCGGAGGA<br>CTGGTCAAGCCTGGCGGCAGCCTGAAACTGT<br>CTTGCGCCGCCAGCGGCTTCACCTTCAGCGA<br>CTACTACATGTACTGGGTCCGACAGACCCCT<br>GAGAAGCGGCTGGAATGGGTGGCCACAATC<br>AGCGACGGCGGCAGCTACACCTTCTACCCCG<br>ACAGCGTGAAGGGCCGGTTCACCATCAGCCG<br>GGACAACGCCAAGAACAACCTGTACCTGCAG<br>ATGTCCAGCCTGAAGTCCGAGGACACCGCCA<br>TGTACTACTGCGCCAGAGGCCCCACCTACTA<br>CGGCCTGGATTATTGGGGCCAGGGCACCAC<br>CTGACCGTGTCTAGTGCCAAAACAACAGCAC<br>CAAGTGTCTATCCACTGGCCCCTGTGTGTGG<br>AGATACAACTGGCTCCTCGGTGACTCTAGGA<br>TGCCTGGTCAAGGGTTATTTCCCTGAGCCAG<br>TGACCTTGACCTGGAACTCTGGATCCCTGTCC<br>AGTGGTGTGCACACCTTCCCAGCTGTCCTGC<br>AGTCTGACCTCTACACCCTCAGCAGCTCAGT<br>GACTGTAACCTCGAGCACCTGGCCCAGCCAG<br>TCCATCACCTGCAATGTGGCCCACCCGGCAA<br>GCAGCACCAAGGTGGACAAGAAAATTGAGC<br>CCAGAGGGCCCACAATCAAGCCCTGTCCTCC<br>ATGCAAATGCCCAGCACCTAACCTCTTGGGT<br>GGACCATCCGTCTTCATCTTCCCTCCAAAGAT<br>CAAGGATGTACTCATGATCTCCCTGAGCCCC<br>ATAGTCACATGTGTGGTGGTGGATGTGAGCG<br>AGGATGACCCAGATGTCCAGATCAGCTGGTT<br>TGTGAACAACGTGGAAGTACACACAGCTCAG<br>ACACAAACCCATAGAGAGGATTACAACAGT<br>ACTCTCCGGGTGGTCAGTGCCCTCCCCATCC<br>AGCACCAGGACTGGATGAGTGGCAAGGAGT<br>TCAAATGCAAGGTCAACAACAAAGACCTCCC<br>AGCGCCCATCGAGAGAACCATCTCAAAACCC<br>AAAGGGTCAGTAAGAGCTCCACAGGTATATG<br>TCTTGCCTCCACCAGAAGAAGAGATGACTAA<br>GAAACAGGTCACTCTGACCTGCATGGTCACA<br>GACTTCATGCCTGAAGACATTTACGTGGAGT | 846 |

TABLE 26-continued

LukAB Antibody Heavy Chain CDSs

| mAb/Fab name | Construct ID | Heavy Chain CDS | SEQ ID NO: |
|---|---|---|---|
| | | GGACCAACAACGGGAAAACAGAGCTAAACT<br>ACAAGAACACTGAACCAGTCCTGGACTCTGA<br>TGGTTCTTACTTCATGTACAGCAAGCTGAGA<br>GTGGAAAAGAAGAACTGGGTGGAAAGAAAT<br>AGCTACTCCTGTTCAGTGGTCCACGAGGGTC<br>TGCACAATCACCACACGACTAAGAGCTTCTC<br>CCGGACTCCGGGTAAA | |
| SM1B248 | pDR000030222 | CAGGTCCAGCTGCAGCAGCCTGGCGCTGAAC<br>TCGTCAGACCTGGCGCTTCTGTGCGGCTGAG<br>CTGCAAGGCCAGCGGCTACAGCTTCACCAGC<br>TACTGGATGAGCTGGGTCAAAGTGCGGCCAG<br>GCCAGGGCCTGGAATGGATCGGAATGATCCA<br>CCCCAGCGACAGCGAGACACGGCTGAACCA<br>GAAGTTCAAGGACAAGGCCACCCTGACCGTG<br>GACAAGAGCAGCAGCACCGCCTACATGCAG<br>CTGTCCAGCCCCACAAGCGAGGACAGCGCCG<br>TGTACTACTGCGCCAGACTGTACGTGGACTT<br>CTTCGACTACTGGGGCCAGGGCACCACACTG<br>ACAGTGTCCTCTGCCAAAACAACAGCACCAA<br>GTGTCTATCCACTGGCCCCTGTGTGTGGAGA<br>TACAACTGGCTCCTCGGTGACTCTAGGATGC<br>CTGGTCAAGGGTTATTTCCCTGAGCCAGTGA<br>CCTTGACCTGGAACTCTGGATCCCTGTCCAGT<br>GGTGTGCACACCTTCCCAGCTGTCCTGCAGT<br>CTGACCTCTACACCCTCAGCAGCTCAGTGAC<br>TGTAACCTCGAGCACCTGGCCCAGCCAGTCC<br>ATCACCTGCAATGTGGCCCACCCGGCAAGCA<br>GCACCAAGGTGGACAAGAAAATTGAGCCCA<br>GAGGGCCCACAATCAAGCCCTGTCCTCCATG<br>CAAATGCCCAGCACCTAACCTCTTGGGTGGA<br>CCATCCGTCTTCATCTTCCCTCCAAAGATCAA<br>GGATGTACTCATGATCTCCCTGAGCCCCATA<br>GTCACATGTGTGGTGGTGGATGTGAGCGAGG<br>ATGACCCAGATGTCCAGATCAGCTGGTTTGT<br>GAACAACGTGGAAGTACACACAGCTCAGAC<br>ACAAACCCATAGAGAGGATTACAACAGTACT<br>CTCCGGGTGGTCAGTGCCCTCCCCATCCAGC<br>ACCAGGACTGGATGAGTGGCAAGGAGTTCA<br>AATGCAAGGTCAACAACAAAGACCTCCCAGC<br>GCCCATCGAGAGAACCATCTCAAAACCCAAA<br>GGGTCAGTAAGAGCTCCACAGGTATATGTCT<br>CTCCACCAGAAGAAGAGATGACTAAGATGC<br>AACAGGTCACTCTGACCTGCATGGTCACAGA<br>CTTCATGCCTGAAGACATTTACGTGGAGTGG<br>ACCAACAACGGGAAAACAGAGCTAAACTAC<br>AAGAACACTGAACCAGTCCTGGACTCTGATG<br>GTTCTTACTTCATGTACAGCAAGCTGAGAGT<br>GGAAAAGAAGAACTGGGTGGAAAGAAATAG<br>CTACTCCTGTTCAGTGGTCCACGAGGGTCTG<br>CACAATCACCACACGACTAAGAGCTTCTCCC<br>GGACTCCGGGTAAA | 847 |
| 5M1B249 | pDR000030223 | GACGTGAAGCTGGTGGAATCTGGCGGCGGAC<br>TGGTCAAGCTGGGCGGCAGCCTGAAACTGTC<br>TTGCGCCGCCAGCGGCTTCACCTTCAGCAGC<br>TACTACATGAGCTGGGTCCGACAGACCCCTG<br>AGAAGCGGCTGGAACTGGTGGCCGCCATCAA<br>CAGCAATGGCGGCAGCACCTACTACCCCGAC<br>ACCGTGAAGGGCCGGTTCACCATCTCCCGGG<br>ACAACGCCAAGAACACCCTGTACCTGCAGAT<br>GTCCAGCCTGAAGTCCGAGGACACCGCCCTG<br>TACTACTGCGCCAGACCCGACTACCCCTACG<br>CCATGGATTACTGGGGCCAGGGCACCAGCGT<br>GACCGTGTCATCTGCCAAAACAACAGCACCA<br>AGTGTCTATCCACTGGCCCCTGTGTGTGGAG<br>ATACAACTGGCTCCTCGGTGACTCTAGGATG<br>CCTGGTCAAGGGTTATTTCCCTGAGCCAGTG<br>ACCTTGACCTGGAACTCTGGATCCCTGTCCA<br>GTGGTGTGCACACCTTCCCAGCTGTCCTGCA<br>GTCTGACCTCTACACCCTCAGCAGCTCAGTG<br>ACTGTAACCTCGAGCACCTGGCCCAGCCAGT<br>CCATCACCTGCAATGTGGCCCACCCGGCAAG<br>CAGCACCAAGGTGGACAAGAAAATTGAGCC<br>CAGAGGGCCCACAATCAAGCCCTGTCCTCCA | 848 |

TABLE 26-continued

LukAB Antibody Heavy Chain CDSs

| mAb/Fab name | Construct ID | Heavy Chain CDS | SEQ ID NO: |
|---|---|---|---|
| | | TGCAAATGCCCAGCACCTAACCTCTTGGGTG<br>GACCATCCGTCTTCATCTTCCCTCCAAAGATC<br>AAGGATGTACTCATGATCTCCCTGAGCCCCA<br>TAGTCACATGTGTGGTGGTGGATGTGAGCGA<br>GGATGACCCAGATGTCCAGATCAGCTGGTTT<br>GTGAACAACGTGGAAGTACACACAGCTCAG<br>ACACAAACCCATAGAGAGGATTACAACAGT<br>ACTCTCCGGGTGGTCAGTGCCCTCCCCATCC<br>AGCACCAGGACTGGATGAGTGGCAAGGAGT<br>TCAAATGCAAGGTCAACAACAAAGACCTCCC<br>AGCGCCCATCGAGAGAACCATCTCAAAACCC<br>AAAGGGTCAGTAAGAGCTCCACAGGTATATG<br>TCTTGCCTCCACCAGAAGAAGAGATGACTAA<br>GAAACAGGTCACTCTGACCTGCATGGTCACA<br>GACTTCATGCCTGAAGACATTTACGTGGAGT<br>GGACCAACAACGGGAAAACAGAGCTAAACT<br>ACAAGAACACTGAACCAGTCCTGGACTCTGA<br>TGGTTCTTACTTCATGTACAGCAAGCTGAGA<br>GTGGAAAAGAAGAACTGGGTGGAAAGAAAT<br>AGCTACTCCTGTTCAGTGGTCCACGAGGGTC<br>TGCACAATCACCACACGACTAAGAGCTTCTC<br>CCGGACTCCGGGTAAA | |
| SM1B250 | pDR000030224 | CAGATCCAGCTGGTGCAGAGCGGCCCTGAGC<br>TGAAGAAACCCGGCGAGACAGTGAAGATCA<br>GCTGCAAGGCCAGCGGCTACACCTTCACCAA<br>CTACGGCATGAACTGGGTCAAGCAGGCCCCT<br>GGCAAGGGCCTGAAGTGGATGGGCTGGATC<br>AACACCTACACCGGCGAGCCCACCTACGCCG<br>ACGACTTCAAGGGCAGATTCGCCTTCAGCCT<br>GGAAACCAGCGCCAGCACCGCCTACCTGCAG<br>ATCAACAACCTGAAGAACGAGGACACCGCC<br>ACCTACTTTTGCGCCAGAAGCCCCAGCTACG<br>GCAGCAGAGGCGCTTGGTTTGCCTATTGGAG<br>CCAGGGCACCCTGGTCACCGTGTCTGCTGCC<br>AAAACAACAGCACCAAGTGTCTATCCACTGG<br>CCCCTGTGTGTGGAGATACAACTGGCTCCTC<br>GGTGACTCTAGGATGCCTGGTCAAGGGTTAT<br>TTCCCTGAGCCAGTGACCTTGACCTGGAACT<br>CTGGATCCCTGTCCAGTGGTGTGCACACCTTC<br>CCAGCTGTCCTGCAGTCTGACCTCTACACCCT<br>CAGCAGCTCAGTGACTGTAACCTCGAGCACC<br>TGGCCCAGCCAGTCCATCACCTGCAATGTGG<br>CCCACCCGGCAAGCAGCACCAAGGTGGACA<br>AGAAAATTGAGCCCAGAGGGCCCACAATCA<br>AGCCCTGTCCTCCATGCAAATGCCCAGCACC<br>TAACCTCTTGGGTGGACCATCCGTCTTCATCT<br>TCCCTCCAAAGATCAAGGATGTACTCATGAT<br>CTCCCTGAGCCCCATAGTCACATGTGTGGTG<br>GTGGATGTGAGCGAGGATGACCCAGATGTCC<br>AGATCAGCTGGTTTGTGAACAACGTGGAAGT<br>ACACACAGCTCAGACACAAACCCATAGAGA<br>GGATTACAACAGTACTCTCCGGGTGGTCAGT<br>GCCCTCCCCATCCAGCACCAGGACTGGATGA<br>GTGGCAAGGAGTTCAAATGCAAGGTCAACA<br>ACAAAGACCTCCCAGCGCCCATCGAGAGAAC<br>CATCTCAAAACCCAAAGGGTCAGTAAGAGCT<br>CCACAGGTATATGTCTTGCCTCCACCAGAAG<br>AAGAGATGACTAAGAAACAGGTCACTCTGAC<br>CTGCATGGTCACAGACTTCATGCCTGAAGAC<br>ATTTACGTGGAGTGGACCAACAACGGGAAA<br>ACAGAGCTAAACTACAAGAACACTGAACCA<br>GTCCTGGACTCTGATGGTTCTTACTTCATGTA<br>CAGCAAGCTGAGAGTGGAAAAGAAGAACTG<br>GGTGGAAAGAAATAGCTACTCCTGTTCAGTG<br>GTCCACGAGGGTCTGCACAATCACCACACGA<br>CTAAGAGCTTCTCCCGGACTCCGGGTAAA | 849 |
| SM1B251 | pDR000030225 | CAGATCCAGCTGGTGCAGAGCGGCCCTGAGC<br>TGAAGAAACCCGGCGAGACAGTGAAGATCA<br>GCTGCAAGGCCAGCGGCTACACCTTCACCAA<br>CTACGGCATGAACTGGGTCAAGCAGGCCCCT<br>GGCAAGGGCCTGAAGTGGATGGGCTGGATC<br>AACACCTACACCGGCGAGCCCACCTACGCCG<br>ACGACTTCAAGGGCAGATTCGCCTTCAGCCT | 850 |

TABLE 26-continued

LukAB Antibody Heavy Chain CDSs

| mAb/Fab name | Construct ID | Heavy Chain CDS | SEQ ID NO: |
|---|---|---|---|
| | | GGAAACCAGCGCCAGCACCGCCTACCTGCAG<br>ATCAACAACCTGAAGAACGAGGACACCGCC<br>ACCTACTTTTGCGCCAGAAGCCCCAGCTACG<br>GCAGCAGAGGCGCTTGGTTTGCCTACTGGGG<br>CCAGGGCACCCTGGTCACAGTGTCTGCTGCC<br>AAAACAACAGCACCAAGTGTCTATCCACTGG<br>CCCCTGTGTGTGGAGATACAACTGGCTCCTC<br>GGTGACTCTAGGATGCCTGGTCAAGGGTTAT<br>TTCCCTGAGCCAGTGACCTTGACCTGGAACT<br>CTGGATCCCTGTCCAGTGGTGTGCACACCTTC<br>CCAGCTGTCCTGCAGTCTGACCTCTACACCCT<br>CAGCAGCTCAGTGACTGTAACCTCGAGCACC<br>TGGCCCAGCCAGTCCATCACCTGCAATGTGG<br>CCCACCCGGCAAGCAGCACCAAGGTGGACA<br>AGAAAATTGAGCCCAGAGGGCCCACAATCA<br>AGCCCTGTCCTCCATGCAAATGCCCAGCACC<br>TAACCTCTTGGGTGGACCATCCGTCTTCATCT<br>TCCCTCCAAAGATCAAGGATGTACTCATGAT<br>CTCCCTGAGCCCCATAGTCACATGTGTGGTG<br>GTGGATGTGAGCGAGGATGACCCAGATGTCC<br>AGATCAGCTGGTTTGTGAACAACGTGGAAGT<br>ACACACAGCTCAGACACAAACCCATAGAGA<br>GGATTACAACAGTACTCTCCGGGTGGTCAGT<br>GCCCTCCCCATCCAGCACCAGGACTGGATGA<br>GTGGCAAGGAGTTCAAATGCAAGGTCAACA<br>ACAAAGACCTCCCAGCGCCCATCGAGAGAAC<br>CATCTCAAAACCCAAAGGGTCAGTAAGAGCT<br>CCACAGGTATATGTCTTGCCTCCACCAGAAG<br>AAGAGATGACTAAGAAACAGGTCACTCTGAC<br>CTGCATGGTCACAGACTTCATGCCTGAAGAC<br>ATTTACGTGGAGTGGACCAACAACGGGAAA<br>ACAGAGCTAAACTACAAGAACACTGAACCA<br>GTCCTGGACTCTGATGGTTCTTACTTCATGTA<br>CAGCAAGCTGAGAGTGGAAAAGAAGAACTG<br>GGTGGAAAGAAATAGCTACTCCTGTTCAGTG<br>GTCCACGAGGGTCTGCACAATCACCACACGA<br>CTAAGAGCTTCTCCCGGACTCCGGGTAAA | |
| 5M1B252 | pDR000030226 | CAGGTCCAGCTGCAGCAGAGCGGAGCCGAA<br>CTGATGAAGCCTGGGGCCAGCGTGAAGATCA<br>GCTGCAAGGCCAGCGGCTACACCTTCAGCGA<br>CTACTGGATCGAGTGGATCAAGCAGCGGCCT<br>GGCCACGGCCTGGAATGGATGGGAGAGATC<br>CTGCCCGGCAGCGACAAGACCAACTACAACG<br>AGAAGTTCAAGGGCAAGGCCACCTTCACCGC<br>CGACAGCAGCAGCAACACCGCCTACATGCAG<br>CTGAACAGCCTGACCAGCGAGGACAGCGCC<br>GTGTTCTATTGTGCCACAGCCGGCGACGACT<br>ACGTGAAGTGGGGACAGGGCACCCTGGTCAC<br>CGTGTCTGCTGCCAAAACAACAGCACCAAGT<br>GTCTATCCACTGGCCCCTGTGTGTGGAGATA<br>CAACTGGCTCCTCGGTGACTCTAGGATGCCT<br>GGTCAAGGGTTATTTCCCTGAGCCAGTGACC<br>TTGACCTGGAACTCTGGATCCCTGTCCAGTG<br>GTGTGCACACCTTCCCAGCTGTCCTGCAGTCT<br>GACCTCTACACCCTCAGCAGCTCAGTGACTG<br>TAACCTCGAGCACCTGGCCCAGCCAGTCCAT<br>CACCTGCAATGTGGCCCACCCGGCAAGCAGC<br>ACCAAGGTGGACAAGAAAATTGAGCCCAGA<br>GGGCCCACAATCAAGCCCTGTCCTCCATGCA<br>AATGCCCAGCACCTAACCTCTTGGGTGGACC<br>ATCCGTCTTCATCTTCCCTCCAAAGATCAAGG<br>ATGTACTCATGATCTCCCTGAGCCCCATAGTC<br>ACATGTGTGGTGGTGGATGTGAGCGAGGATG<br>ACCCAGATGTCCAGATCAGCTGGTTTGTGAA<br>CAACGTGGAAGTACACACAGCTCAGACACA<br>AACCCATAGAGAGGATTACAACAGTACTCTC<br>CGGGTGGTCAGTGCCCTCCCCATCCAGCACC<br>AGGACTGGATGAGTGGCAAGGAGTTCAAAT<br>GCAAGGTCAACAACAAAGACCTCCCAGCGCC<br>CATCGAGAGAACCATCTCAAAACCCAAAGG<br>GTCAGTAAGAGCTCCACAGGTATATGTCTTG<br>CCTCCACCAGAAGAAGAGATGACTAAGAAA<br>CAGGTCACTCTGACCTGCATGGTCACAGACT<br>TCATGCCTGAAGACATTTACGTGGAGTGGAC | 851 |

TABLE 26-continued

LukAB Antibody Heavy Chain CDSs

| mAb/Fab name | Construct ID | Heavy Chain CDS | SEQ ID NO: |
|---|---|---|---|
| | | CAACAACGGGAAAACAGAGCTAAACTACAA GAACACTGAACCAGTCCTGGACTCTGATGGT TCTTACTTCATGTACAGCAAGCTGAGAGTGG AAAAGAAGAACTGGGTGGAAAGAAATAGCT ACTCCTGTTCAGTGGTCCACGAGGGTCTGCA CAATCACCACACGACTAAGAGCTTCTCCCGG ACTCCGGGTAAA | |
| 5M1B253 | pDR000030227 | GAAGTCCAGCTGCAGCAGAGCGGAGCCGAA CTGGTCAAGCCTGGCGCTTCCGTGAAGCTGA GCTGCACCGCCAGCGGCTTCAACATCAAGGA CACCTACATGCACTGGGTCCGACAGAGGCCC GAGCAGGGCCTGGAATGGATCGGCAGAATC GACCCCGCCAACGACATCACCAAATACGACC CCAAGTTCCAGGGCAAGGCCACCATCACCGC CGACACCAGCAGCAACACAGCCTACCTGCAG CTGAGCAGCCTGACCAGCGAGGACACCGCCG TGTACTACTGCGGCAGAGACTGGGCCGATTA CTGGGGCCAGGGCACCACCCTGACAGTGTCT AGTGCCAAAACAACAGCACCAAGTGTCTATC CACTGGCCCCTGTGTGTGGAGATACAACTGG CTCCTCGGTGACTCTAGGATGCCTGGTCAAG GGTTATTTCCCTGAGCCAGTGACCTTGACCTG GAACTCTGGATCCCTGTCCAGTGGTGTGCAC ACCTTCCCAGCTGTCCTGCAGTCTGACCTCTA CACCCTCAGCAGCTCAGTGACTGTAACCTCG AGCACCTGGCCCAGCCAGTCCATCACCTGCA ATGTGGCCCACCCGGCAAGCAGCACCAAGGT GGACAAGAAAATTGAGCCCAGAGGGCCCAC AATCAAGCCCTGTCCTCCATGCAAATGCCCA GCACCTAACCTCTTGGGTGGACCATCCGTCTT CATCTTCCCTCCAAAGATCAAGGATGTACTC ATGATCTCCCTGAGCCCCATAGTCACATGTG TGGTGGTGGATGTGAGCGAGGATGACCCAGA TGTCCAGATCAGCTGGTTTGTGAACAACGTG GAAGTACACACAGCTCAGACACAAACCCATA GAGAGGATTACAACAGTACTCTCCGGGTGGT CAGTGCCCTCCCCATCCAGCACCAGGACTGG ATGAGTGGCAAGGAGTTCAAATGCAAGGTCA ACAACAAAGACCTCCCAGCGCCCATCGAGAG AACCATCTCAAAACCCAAAGGGTCAGTAAGA GCTCCACAGGTATATGTCTTGCCTCCACCAG AAGAAGAGATGACTAAGAAACAGGTCACTC TGACCTGCATGGTCACAGACTTCATGCCTGA AGACATTTACGTGGAGTGGACCAACAACGGG AAAACAGAGCTAAACTACAAGAACACTGAA CCAGTCCTGGACTCTGATGGTTCTTACTTCAT GTACAGCAAGCTGAGAGTGGAAAAGAAGAA CTGGGTGGAAAGAAATAGCTACTCCTGTTCA GTGGTCCACGAGGGTCTGCACAATCACCACA CGACTAAGAGCTTCTCCCGGACTCCGGGTAA A | 852 |
| 5M1B254 | pDR000030228 | GAAGTCCAGCTGCAGCAGAGCGGAGCCGAA CTGGTCAAGCCTGGCGCTTCCGTGAAGCTGA GCTGCACCGCCAGCGGCTTCAACATCAAGGA CACCTACATGCACTGGGTCAAGCAGCGGAGC GAGCAGGGCCTGGAATGGATCGGCAGAATC AACCCCGCCAACGACAACACCAAATACGACC CCAAGTTCCAGGGCAAGGCCACCATCACCGC CGACACCAGCAGCAACACAGCCTACCTGCAG CTGAGCAGCCTGACCAGCGAGGACACCGCCG TGTACTACTGCGGCAGAGACTGGGCCGATTA CTGGGGCCAGGGCACCACCCTGACAGTGTCT AGTGCCAAAACAACAGCACCAAGTGTCTATC CACTGGCCCCTGTGTGTGGAGATACAACTGG CTCCTCGGTGACTCTAGGATGCCTGGTCAAG GGTTATTTCCCTGAGCCAGTGACCTTGACCTG GAACTCTGGATCCCTGTCCAGTGGTGTGCAC ACCTTCCCAGCTGTCCTGCAGTCTGACCTCTA CACCCTCAGCAGCTCAGTGACTGTAACCTCG AGCACCTGGCCCAGCCAGTCCATCACCTGCA ATGTGGCCCACCCGGCAAGCAGCACCAAGGT GGACAAGAAAATTGAGCCCAGAGGGCCCAC AATCAAGCCCTGTCCTCCATGCAAATGCCCA | 853 |

TABLE 26-continued

LukAB Antibody Heavy Chain CDSs

| mAb/Fab name | Construct ID | Heavy Chain CDS | SEQ ID NO: |
|---|---|---|---|
| | | GCACCTAACCTCTTGGGTGGACCATCCGTCTT<br>CATCTTCCCTCCAAAGATCAAGGATGTACTC<br>ATGATCTCCCTGAGCCCCATAGTCACATGTG<br>TGGTGGTGGATGTGAGCGAGGATGACCCAGA<br>TGTCCAGATCAGCTGGTTTGTGAACAACGTG<br>GAAGTACACACAGCTCAGACACAAACCCATA<br>GAGAGGATTACAACAGTACTCTCCGGGTGGT<br>CAGTGCCCTCCCCATCCAGCACCAGGACTGG<br>ATGAGTGGCAAGGAGTTCAAATGCAAGGTCA<br>ACAACAAAGACCTCCCAGCGCCCATCGAGAG<br>AACCATCTCAAAACCCAAAGGGTCAGTAAGA<br>GCTCCACAGGTATATGTCTTGCCTCCACCAG<br>AAGAAGAGATGACTAAGAAACAGGTCACTC<br>TGACCTGCATGGTCACAGACTTCATGCCTGA<br>AGACATTTACGTGGAGTGGACCAACAACGGG<br>AAAACAGAGCTAAACTACAAGAACACTGAA<br>CCAGTCCTGGACTCTGATGGTTCTTACTTCAT<br>GTACAGCAAGCTGAGAGTGGAAAAGAAGAA<br>CTGGGTGGAAAGAAATAGCTACTCCTGTTCA<br>GTGGTCCACGAGGGTCTGCACAATCACCACA<br>CGACTAAGAGCTTCTCCCGGACTCCGGGTAA<br>A | |
| SM1B255 | pDR000030229 | CAGGTCCAGCTGCAGCAGCCTGGCGCTGAAC<br>TGGTCAAGCCAGGCGCTTCCGTGAAGCTGAG<br>CTGCAAGGCCAGCGGCTACACCTTCACCCGG<br>TACTGGATGCACTGGGTCAAGCAGAGGCCAG<br>GCCAGGGCCTGGAATGGATCGGCGAGATCA<br>ACCCCAACAACGGCCACACCAACTACAACGA<br>GAAGTTCGAGAGCCGGGCCACCCTGACCGTG<br>GACAAGAGCAGCAGCACCGCCTACATGCAGT<br>TCAACAGCCTGACCAGCGAGGACAGCGCCGT<br>GTACTACTGCGGCAGACTGGATGGCCACCTG<br>TACGCCGTGGATTACTGGGGCCAGGGCACCA<br>GCGTGACCGTGTCATCTGCCAAAACAACAGC<br>ACCAAGTGTCTATCCACTGGCCCCTGTGTGT<br>GGAGATACAACTGGCTCCTCGGTGACTCTAG<br>GATGCCTGGTCAAGGGTTATTTCCCTGAGCC<br>AGTGACCTTGACCTGGAACTCTGGATCCCTG<br>TCCAGTGGTGTGCACACCTTCCCAGCTGTCCT<br>GCAGTCTGACCTCTACACCCTCAGCAGCTCA<br>GTGACTGTAACCTCGAGCACCTGGCCCAGCC<br>AGTCCATCACCTGCAATGTGGCCCACCCGGC<br>AAGCAGCACCAAGGTGGACAAGAAAATTGA<br>GCCCAGAGGGCCCACAATCAAGCCCTGTCCT<br>CCATGCAAATGCCCAGCACCTAACCTCTTGG<br>GTGGACCATCCGTCTTCATCTTCCCTCCAAAG<br>ATCAAGGATGTACTCATGATCTCCCTGAGCC<br>CCATAGTCACATGTGTGGTGGTGGATGTGAG<br>CGAGGATGACCCAGATGTCCAGATCAGCTGG<br>TTTGTGAACAACGTGGAAGTACACACAGCTC<br>AGACACAAACCCATAGAGAGGATTACAACA<br>GTACTCTCCGGGTGGTCAGTGCCCTCCCCATC<br>CAGCACCAGGACTGGATGAGTGGCAAGGAG<br>TTCAAATGCAAGGTCAACAACAAAGACCTCC<br>CAGCGCCCATCGAGAGAACCATCTCAAAACC<br>CAAAGGGTCAGTAAGAGCTCCACAGGTATAT<br>GTCTTGCCTCCACCAGAAGAAGAGATGACTA<br>AGAAACAGGTCACTCTGACCTGCATGGTCAC<br>AGACTTCATGCCTGAAGACATTTACGTGGAG<br>TGGACCAACAACGGGAAAACAGAGCTAAAC<br>TACAAGAACACTGAACCAGTCCTGGACTCTG<br>ATGGTTCTTACTTCATGTACAGCAAGCTGAG<br>AGTGGAAAAGAAGAACTGGGTGGAAAGAAA<br>TAGCTACTCCTGTTCAGTGGTCCACGAGGGT<br>CTGCACAATCACCACACGACTAAGAGCTTCT<br>CCCGGACTCCGGGTAAA | 854 |
| SM1B256 | pDR000030230 | CAGGTCCAGCTGCAGCAGCCTGGCACAGAGC<br>TGAAGATGCCCGGCACCAGCGTGAAGCTGAG<br>CTGCAAGGCCAGCGGCTACACCTTCACCACC<br>TACTGGATGCACTGGGTCAAGCTGCGCCAG<br>GCCAGGGCTTTGAGTGGATCGGCGAGATCAA<br>CCCCAGCAACGACGGCACCAACTACAACGA<br>GAAGTTCAAGCGGAAGGCCACCCTGACCGTG | 855 |

TABLE 26-continued

LukAB Antibody Heavy Chain CDSs

| mAb/Fab name | Construct ID | Heavy Chain CDS | SEQ ID NO: |
| --- | --- | --- | --- |
| | | GACAAGCCTAGCAGCACCGCCTACATGCAGC<br>TGTCCAGCCTGACCAGCGAGGACAGCACCAT<br>CTACTACTGCACCATCAGCTACTACGGCTAC<br>GGCGACTTCGACTACTGGGGCCAGGGCACCA<br>CACTGACAGTGTCCTCTGCCAAAACAACAGC<br>ACCAAGTGTCTATCCACTGGCCCCTGTGTGT<br>GGAGATACAACTGGCTCCTCGGTGACTCTAG<br>GATGCCTGGTCAAGGGTTATTTCCCTGAGCC<br>AGTGACCTTGACCTGGAACTCTGGATCCCTG<br>TCCAGTGGTGTGCACACCTTCCCAGCTGTCCT<br>GCAGTCTGACCTCTACACCCTCAGCAGCTCA<br>GTGACTGTAACCTCGAGCACCTGGCCCAGCC<br>AGTCCATCACCTGCAATGTGGCCCACCCGGC<br>AAGCAGCACCAAGGTGGACAAGAAAATTGA<br>GCCCAGAGGGCCCACAATCAAGCCCTGTCCT<br>CCATGCAAATGCCCAGCACCTAACCTCTTGG<br>GTGGACCATCCGTCTTCATCTTCCCTCCAAAG<br>ATCAAGGATGTACTCATGATCTCCCTGAGCC<br>CCATAGTCACATGTGTGGTGGTGGATGTGAG<br>CGAGGATGACCCAGATGTCCAGATCAGCTGG<br>TTTGTGAACAACGTGGAAGTACACACAGCTC<br>AGACACAAACCCATAGAGAGGATTACAACA<br>GTACTCTCCGGGTGGTCAGTGCCCTCCCCATC<br>CAGCACCAGGACTGGATGAGTGGCAAGGAG<br>TTCAAATGCAAGGTCAACAACAAAGACCTCC<br>CAGCGCCCATCGAGAGAACCATCTCAAAACC<br>CAAAGGGTCAGTAAGAGCTCCACAGGTATAT<br>GTCTTGCCTCCACCAGAAGAAGAGATGACTA<br>AGAAACAGGTCACTCTGACCTGCATGGTCAC<br>AGACTTCATGCCTGAAGACATTTACGTGGAG<br>TGGACCAACAACGGGAAAACAGAGCTAAAC<br>TACAAGAACACTGAACCAGTCCTGGACTCTG<br>ATGGTTCTTACTTCATGTACAGCAAGCTGAG<br>AGTGGAAAAGAAGAACTGGGTGGAAAGAAA<br>TAGCTACTCCTGTTCAGTGGTCCACGAGGGT<br>CTGCACAATCACCACACGACTAAGAGCTTCT<br>CCCGGACTCCGGGTAAA | |
| SM1B257 | pDR000030231 | CAGGTGCAGCTGAAAGAGTCCGGCCCTGATC<br>TGGTGCAGCCCAGCCAGACCCTGAGCCTGAC<br>CTGTACCGTGTCCGGCTTCAGCCTGACCAGC<br>TACGGCGTGCACTGGGTCCGACAGCCACCTG<br>GCAAAGGCCTGGAATGGGTCGGAACCATGG<br>GCTGGAACGACAAGAAGTACTACAACAGCG<br>CCCTGAAGTCCCGGCTGAGCATCAGCAGAAA<br>CACCAGCAAGAACCAGGTGTTCCTGAAGCTG<br>AGCAGCCTGCAGACCGAGGACACCGCCATGT<br>ACTACTGCACCAGGGACGGCGATAGCAGCG<br>GCAGTTGGTTCGCCTATTGGGGCCAGGGCAC<br>CCTGGTCACCGTGTCTAGTGCAAAACAACA<br>GCACCAAGTGTCTATCCACTGGCCCCTGTGT<br>GTGGAGATACAACTGGCTCCTCGGTGACTCT<br>AGGATGCCTGGTCAAGGGTTATTTCCCTGAG<br>CCAGTGACCTTGACCTGGAACTCTGGATCCC<br>TGTCCAGTGGTGTGCACACCTTCCCAGCTGTC<br>CTGCAGTCTGACCTCTACACCCTCAGCAGCT<br>CAGTGACTGTAACCTCGAGCACCTGGCCCAG<br>CCAGTCCATCACCTGCAATGTGGCCCACCCG<br>GCAAGCAGCACCAAGGTGGACAAGAAAATT<br>GAGCCCAGAGGGCCCACAATCAAGCCCTGTC<br>CTCCATGCAAATGCCCAGCACCTAACCTCTT<br>GGGTGGACCATCCGTCTTCATCTTCCCTCCAA<br>AGATCAAGGATGTACTCATGATCTCCCTGAG<br>CCCCATAGTCACATGTGTGGTGGTGGATGTG<br>AGCGAGGATGACCCAGATGTCCAGATCAGCT<br>GGTTTGTGAACAACGTGGAAGTACACACAGC<br>TCAGACACAAACCCATAGAGAGGATTACAAC<br>AGTACTCTCCGGGTGGTCAGTGCCCTCCCCA<br>TCCAGCACCAGGACTGGATGAGTGGCAAGG<br>AGTTCAAATGCAAGGTCAACAACAAAGACCT<br>CCCAGCGCCCATCGAGAGAACCATCTCAAAA<br>CCCAAAGGGTCAGTAAGAGCTCCACAGGTAT<br>ATGTCTTGCCTCCACCAGAAGAAGAGATGAC<br>TAAGAAACAGGTCACTCTGACCTGCATGGTC<br>ACAGACTTCATGCCTGAAGACATTTACGTGG | 856 |

TABLE 26-continued

LukAB Antibody Heavy Chain CDSs

| mAb/Fab name | Construct ID | Heavy Chain CDS | SEQ ID NO: |
|---|---|---|---|
| | | AGTGGACCAACAACGGGAAAACAGAGCTAA<br>ACTACAAGAACACTGAACCAGTCCTGGACTC<br>TGATGGTTCTTACTTCATGTACAGCAAGCTG<br>AGAGTGGAAAAGAAGAACTGGGTGGAAAGA<br>AATAGCTACTCCTGTTCAGTGGTCCACGAGG<br>GTCTGCACAATCACCACACGACTAAGAGCTT<br>CTCCCGGACTCCGGGTAAA | |
| SM1B258 | pDR000030232 | CAGGTGCAGCTGAAAGAGTCCGGCCCTGATC<br>TGGTGCAGCCCAGCCAGACCCTGAGCCTGAC<br>CTGTACCGTGTCCGGCTTCAGCCTGACAGGC<br>TACGCTGTGCATTGGGTCCGACAGCCTCCAG<br>GCAAGGGCGTGGAATGGGTCGGAACCATGG<br>GCTGGGACGACAAGAAGTTCTACAACAGCGC<br>CCTGAAGTCCCGGCTGAGCATCTCCAGGGAC<br>CCCAGCAAGAACCAGGTGTTCTTCAAGCTGA<br>GCAGCCTGCAGACCGAGGACACCGCCATGTA<br>CTACTGCACCAGGGATCACGGCGACGGCGGC<br>TTTGCCTATTGGGGCCAGGGAACCCTGGTCA<br>CCGTGTCCTCTGCCAAAACAACAGCACCAAG<br>TGTCTATCCACTGGCCCCTGTGTGTGGAGAT<br>ACAACTGGCTCCTCGGTGACTCTAGGATGCC<br>TGGTCAAGGGTTATTTCCCTGAGCCAGTGAC<br>CTTGACCTGGAACTCTGGATCCCTGTCCAGT<br>GGTGTGCACACCTTCCCAGCTGTCCTGCAGT<br>CTGACCTCTACACCCTCAGCAGCTCAGTGAC<br>TGTAACCTCGAGCACCTGGCCCAGCCAGTCC<br>ATCACCTGCAATGTGGCCCACCCGGCAAGCA<br>GCACCAAGGTGGACAAGAAAATTGAGCCCA<br>GAGGGCCCACAATCAAGCCCTGTCCTCCATG<br>CAAATGCCCAGCACCTAACCTCTTGGGTGGA<br>CCATCCGTCTTCATCTTCCCTCCAAAGATCAA<br>GGATGTACTCATGATCTCCCTGAGCCCCATA<br>GTCACATGTGTGGTGGTGGATGTGAGCGAGG<br>ATGACCCAGATGTCCAGATCAGCTGGTTTGT<br>GAACAACGTGGAAGTACACACAGCTCAGAC<br>ACAAACCCATAGAGAGGATTACAACAGTACT<br>CTCCGGGTGGTCAGTGCCCTCCCCATCCAGC<br>ACCAGGACTGGATGAGTGGCAAGGAGTTCA<br>AATGCAAGGTCAACAACAAAGACCTCCCAGC<br>GCCCATCGAGAGAACCATCTCAAAACCCAAA<br>GGGTCAGTAAGAGCTCCACAGGTATATGTCT<br>TGCCTCCACCAGAAGAAGAGATGACTAAGA<br>AACAGGTCACTCTGACCTGCATGGTCACAGA<br>CTTCATGCCTGAAGACATTTACGTGGAGTGG<br>ACCAACAACGGGAAAACAGAGCTAAACTAC<br>AAGAACACTGAACCAGTCCTGGACTCTGATG<br>GTTCTTACTTCATGTACAGCAAGCTGAGAGT<br>GGAAAAGAAGAACTGGGTGGAAAGAAATAG<br>CTACTCCTGTTCAGTGGTCCACGAGGGTCTG<br>CACAATCACCACACGACTAAGAGCTTCTCCC<br>GGACTCCGGGTAAA | 857 |
| SM1B259 | pDR000030233 | GAAGTCCAGCTGCAGCAGTCTGGCCCTGAGC<br>TGGTCAAGCCTGGGGCCAGCGTGAAGATCCC<br>ATGCAAGGCCAGCGGCTACACCTTCACCGAC<br>TACAACATGGACTGGGTCAAGCAGAGCCACG<br>GCAAGAGCCTGGAATGGATCGGCAACATCA<br>ACCCCAACAACGGCGGCACCATCTACAACCA<br>GAACTTCAAGGACCGGGCCACCCTGACCGTG<br>GACAAGAGCAGCAGCACCGCCTACATGGAA<br>CTGCGGAGCCTGACCAGCGAGGACACCGCCG<br>TGTACTACTGCACCAGAGAGAACTCCGGCTA<br>CGGCGGCAACTACTTCGCCTATTGGGGCCAG<br>GGCACCACACTGACAGTGTCCTCTGCCAAAA<br>CAACAGCACCAAGTGTCTATCCACTGGCCCC<br>TGTGTGGAGATACAACTGGCTCCTCGGTG<br>ACTCTAGGATGCCTGGTCAAGGGTTATTTCC<br>CTGAGCCAGTGACCTTGACCTGGAACTCTGG<br>ATCCCTGTCCAGTGGTGTGCACACCTTCCCA<br>GCTGTCCTGCAGTCTGACCTCTACACCCTCAG<br>CAGCTCAGTGACTGTAACCTCGAGCACCTGG<br>CCCAGCCAGTCCATCACCTGCAATGTGGCCC<br>ACCCGGCAAGCAGCACCAAGGTGGACAAGA<br>AAATTGAGCCCAGAGGGCCCACAATCAAGCC | 858 |

TABLE 26-continued

LukAB Antibody Heavy Chain CDSs

| mAb/Fab name | Construct ID | Heavy Chain CDS | SEQ ID NO: |
|---|---|---|---|
| | | CTGTCCTCCATGCAAATGCCCAGCACCTAAC<br>CTCTTGGGTGGACCATCCGTCTTCATCTTCCC<br>TCCAAAGATCAAGGATGTACTCATGATCTCC<br>CTGAGCCCCATAGTCACATGTGTGGTGGTGG<br>ATGTGAGCGAGGATGACCCAGATGTCCAGAT<br>CAGCTGGTTTGTGAACAACGTGGAAGTACAC<br>ACAGCTCAGACACAAACCCATAGAGAGGATT<br>ACAACAGTACTCTCCGGGTGGTCAGTGCCCT<br>CCCCATCCAGCACCAGGACTGGATGAGTGGC<br>AAGGAGTTCAAATGCAAGGTCAACAACAAA<br>GACCTCCCAGCGCCCATCGAGAGAACCATCT<br>CAAAACCCAAAGGGTCAGTAAGAGCTCCAC<br>AGGTATATGTCTTGCCTCCACCAGAAGAAGA<br>GATGACTAAGAAACAGGTCACTCTGACCTGC<br>ATGGTCACAGACTTCATGCCTGAAGACATTT<br>ACGTGGAGTGGACCAACAACGGGAAAACAG<br>AGCTAAACTACAAGAACACTGAACCAGTCCT<br>GGACTCTGATGGTTCTTACTTCATGTACAGCA<br>AGCTGAGAGTGGAAAAGAAGAACTGGGTGG<br>AAAGAAATAGCTACTCCTGTTCAGTGGTCCA<br>CGAGGGTCTGCACAATCACCACACGACTAAG<br>AGCTTCTCCCGGACTCCGGGTAAA | |
| 5M1B260 | pDR000030234 | GAAGTCCAGCTGCAGCAGAGCGGAGCCGAA<br>CTCGTCAGACCTGGCGCTTCCGTGAAGCTGA<br>GCTGCACCACCAGCGGCTTCAACATCAAGGA<br>CAGCCTGATCTACTGGGTCAAGCAGCGGCCC<br>GAGCAGGGCCTGGAATGGATCGGCTGGATTG<br>ACCCCGAGGACGGCGAGACAAAGTTCGCCCC<br>TAGATTCCAGGACAAGGCCACCATCACCAGC<br>GACACCAGCAGCAACACCGCCTACCTGAGAC<br>TGAGCAGCCTGACCAGCGAGGACACCGCCAT<br>CTACTACTGCACCCGGTCCTTCGGCGTGTGTT<br>GGGGCCAGGGAACCCTGGTCACAGTGTCTGC<br>TGCCAAAACAACAGCACCAAGTGTCTATCCA<br>CTGGCCCCTGTGTGTGGAGATACAACTGGCT<br>CCTCGGTGACTCTAGGATGCCTGGTCAAGGG<br>TTATTTCCCTGAGCCAGTGACCTTGACCTGGA<br>ACTCTGGATCCCTGTCCAGTGGTGTGCACAC<br>CTTCCCAGCTGTCCTGCAGTCTGACCTCTACA<br>CCCTCAGCAGCTCAGTGACTGTAACCTCGAG<br>CACCTGGCCCAGCCAGTCCATCACCTGCAAT<br>GTGGCCCACCCGGCAAGCAGCACCAAGGTG<br>GACAAGAAAATTGAGCCCAGAGGGCCCACA<br>ATCAAGCCCTGTCCTCCATGCAAATGCCCAG<br>CACCTAACCTCTTGGGTGGACCATCCGTCTTC<br>ATCTTCCCTCCAAAGATCAAGGATGTACTCA<br>TGATCTCCCTGAGCCCCATAGTCACATGTGT<br>GGTGGTGGATGTGAGCGAGGATGACCCAGAT<br>GTCCAGATCAGCTGGTTTGTGAACAACGTGG<br>AAGTACACACAGCTCAGACACAAACCCATAG<br>AGAGGATTACAACAGTACTCTCCGGGTGGTC<br>AGTGCCCTCCCCATCCAGCACCAGGACTGGA<br>TGAGTGGCAAGGAGTTCAAATGCAAGGTCAA<br>CAACAAAGACCTCCCAGCGCCCATCGAGAGA<br>ACCATCTCAAAACCCAAAGGGTCAGTAAGAG<br>CTCCACAGGTATATGTCTTGCCTCCACCAGA<br>AGAAGAGATGACTAAGAAACAGGTCACTCT<br>GACCTGCATGGTCACAGACTTCATGCCTGAA<br>GACATTTACGTGGAGTGGACCAACAACGGGA<br>AAACAGAGCTAAACTACAAGAACACTGAAC<br>CAGTCCTGGACTCTGATGGTTCTTACTTCATG<br>TACAGCAAGCTGAGAGTGGAAAAGAAGAAC<br>TGGGTGGAAAGAAATAGCTACTCCTGTTCAG<br>TGGTCCACGAGGGTCTGCACAATCACCACAC<br>GACTAAGAGCTTCTCCCGGACTCCGGGTAAA | 859 |
| 5M1B261 | pDR000030234 | GAAGTCCAGCTGCAGCAGAGCGGAGCCGAA<br>CTCGTCAGACCTGGCGCTTCCGTGAAGCTGA<br>GCTGCACCACCAGCGGCTTCAACATCAAGGA<br>CAGCCTGATCTACTGGGTCAAGCAGCGGCCC<br>GAGCAGGGCCTGGAATGGATCGGCTGGATTG<br>ACCCCGAGGACGGCGAGACAAAGTTCGCCCC<br>TAGATTCCAGGACAAGGCCACCATCACCAGC<br>GACACCAGCAGCAACACCGCCTACCTGAGAC | 860 |

TABLE 26-continued

LukAB Antibody Heavy Chain CDSs

| mAb/Fab name | Construct ID | Heavy Chain CDS | SEQ ID NO: |
|---|---|---|---|
| | | TGAGCAGCCTGACCAGCGAGGACACCGCCAT<br>CTACTACTGCACCCGGTCCTTCGGCGTGTGTT<br>GGGGCCAGGGAACCCTGGTCACAGTGTCTGC<br>TGCCAAAACAACAGCACCAAGTGTCTATCCA<br>CTGGCCCCTGTGTGTGGAGATACAACTGGCT<br>CCTCGGTGACTCTAGGATGCCTGGTCAAGGG<br>TTATTTCCCTGAGCCAGTGACCTTGACCTGGA<br>ACTCTGGATCCCTGTCCAGTGGTGTGCACAC<br>CTTCCCAGCTGTCCTGCAGTCTGACCTCTACA<br>CCCTCAGCAGCTCAGTGACTGTAACCTCGAG<br>CACCTGGCCCAGCCAGTCCATCACCTGCAAT<br>GTGGCCCACCCGGCAAGCAGCACCAAGGTG<br>GACAAGAAAATTGAGCCCAGAGGGCCCACA<br>ATCAAGCCCTGTCCTCCATGCAAATGCCCAG<br>CACCTAACCTCTTGGGTGGACCATCCGTCTTC<br>ATCTTCCCTCCAAAGATCAAGGATGTACTCA<br>TGATCTCCCTGAGCCCCATAGTCACATGTGT<br>GGTGGTGGATGTGAGCGAGGATGACCCAGAT<br>GTCCAGATCAGCTGGTTTGTGAACAACGTGG<br>AAGTACACACAGCTCAGACACAAACCCATAG<br>AGAGGATTACAACAGTACTCTCCGGGTGGTC<br>AGTGCCCTCCCCATCCAGCACCAGGACTGGA<br>TGAGTGGCAAGGAGTTCAAATGCAAGGTCAA<br>CAACAAAGACCTCCCAGCGCCCATCGAGAGA<br>ACCATCTCAAAACCCAAAGGGTCAGTAAGAG<br>CTCCACAGGTATATGTCTTGCCTCCACCAGA<br>AGAAGAGATGACTAAGAAACAGGTCACTCT<br>GACCTGCATGGTCACAGACTTCATGCCTGAA<br>GACATTTACGTGGAGTGGACCAACAACGGGA<br>AAACAGAGCTAAACTACAAGAACACTGAAC<br>CAGTCCTGGACTCTGATGGTTCTTACTTCATG<br>TACAGCAAGCTGAGAGTGGAAAAGAAGAAC<br>TGGGTGGAAAGAAATAGCTACTCCTGTTCAG<br>TGGTCCACGAGGGTCTGCACAATCACCACAC<br>GACTAAGAGCTTCTCCCGGACTCCGGGTAAA | |
| 5M1B262 | pDR000030234 | GAAGTCCAGCTGCAGCAGAGCGGAGCCGAA<br>CTCGTCAGACCTGGCGCTTCCGTGAAGCTGA<br>GCTGCACCACCAGCGGCTTCAACATCAAGGA<br>CAGCCTGATCTACTGGGTCAAGCAGCGGCCC<br>GAGCAGGGCCTGGAATGGATCGGCTGGATTG<br>ACCCCGAGGACGGCGAGACAAAGTTCGCCCC<br>TAGATTCCAGGACAAGGCCACCATCACCAGC<br>GACACCAGCAGCAACACCGCCTACCTGAGAC<br>TGAGCAGCCTGACCAGCGAGGACACCGCCAT<br>CTACTACTGCACCCGGTCCTTCGGCGTGTGTT<br>GGGGCCAGGGAACCCTGGTCACAGTGTCTGC<br>TGCCAAAACAACAGCACCAAGTGTCTATCCA<br>CTGGCCCCTGTGTGTGGAGATACAACTGGCT<br>CCTCGGTGACTCTAGGATGCCTGGTCAAGGG<br>TTATTTCCCTGAGCCAGTGACCTTGACCTGGA<br>ACTCTGGATCCCTGTCCAGTGGTGTGCACAC<br>CTTCCCAGCTGTCCTGCAGTCTGACCTCTACA<br>CCCTCAGCAGCTCAGTGACTGTAACCTCGAG<br>CACCTGGCCCAGCCAGTCCATCACCTGCAAT<br>GTGGCCCACCCGGCAAGCAGCACCAAGGTG<br>GACAAGAAAATTGAGCCCAGAGGGCCCACA<br>ATCAAGCCCTGTCCTCCATGCAAATGCCCAG<br>CACCTAACCTCTTGGGTGGACCATCCGTCTTC<br>ATCTTCCCTCCAAAGATCAAGGATGTACTCA<br>TGATCTCCCTGAGCCCCATAGTCACATGTGT<br>GGTGGTGGATGTGAGCGAGGATGACCCAGAT<br>GTCCAGATCAGCTGGTTTGTGAACAACGTGG<br>AAGTACACACAGCTCAGACACAAACCCATAG<br>AGAGGATTACAACAGTACTCTCCGGGTGGTC<br>AGTGCCCTCCCCATCCAGCACCAGGACTGGA<br>TGAGTGGCAAGGAGTTCAAATGCAAGGTCAA<br>CAACAAAGACCTCCCAGCGCCCATCGAGAGA<br>ACCATCTCAAAACCCAAAGGGTCAGTAAGAG<br>CTCCACAGGTATATGTCTTGCCTCCACCAGA<br>AGAAGAGATGACTAAGAAACAGGTCACTCT<br>GACCTGCATGGTCACAGACTTCATGCCTGAA<br>GACATTTACGTGGAGTGGACCAACAACGGGA<br>AAACAGAGCTAAACTACAAGAACACTGAAC<br>CAGTCCTGGACTCTGATGGTTCTTACTTCATG | 861 |

TABLE 26-continued

LukAB Antibody Heavy Chain CDSs

| mAb/Fab name | Construct ID | Heavy Chain CDS | SEQ ID NO: |
| --- | --- | --- | --- |
| | | TACAGCAAGCTGAGAGTGGAAAAGAAGAAC<br>TGGGTGGAAAGAAATAGCTACTCCTGTTCAG<br>TGGTCCACGAGGGTCTGCACAATCACCACAC<br>GACTAAGAGCTTCTCCCGGACTCCGGGTAAA | |
| 5M1B263 | pDR000030234 | GAAGTCCAGCTGCAGCAGAGCGGAGCCGAA<br>CTCGTCAGACCTGGCGCTTCCGTGAAGCTGA<br>GCTGCACCACCAGCGGCTTCAACATCAAGGA<br>CAGCCTGATCTACTGGGTCAAGCAGCGGCCC<br>GAGCAGGGCCTGGAATGGATCGGCTGGATTG<br>ACCCCGAGGACGGCGAGACAAAGTTCGCCCC<br>TAGATTCCAGGACAAGGCCACCATCACCAGC<br>GACACCAGCAGCAACACCGCCTACCTGAGAC<br>TGAGCAGCCTGACCAGCGAGGACACCGCCAT<br>CTACTACTGCACCCGGTCCTTCGGCGTGTGTT<br>GGGGCCAGGGAACCCTGGTCACAGTGTCTGC<br>TGCCAAAACAACAGCACCAAGTGTCTATCCA<br>CTGGCCCCTGTGTGTGGAGATACAACTGGCT<br>CCTCGGTGACTCTAGGATGCCTGGTCAAGGG<br>TTATTTCCCTGAGCCAGTGACCTTGACCTGGA<br>ACTCTGGATCCCTGTCCAGTGGTGTGCACAC<br>CTTCCCAGCTGTCCTGCAGTCTGACCTCTACA<br>CCCTCAGCAGCTCAGTGACTGTAACCTCGAG<br>CACCTGGCCCAGCCAGTCCATCACCTGCAAT<br>GTGGCCCACCCGGCAAGCAGCACCAAGGTG<br>GACAAGAAAATTGAGCCCAGAGGGCCCACA<br>ATCAAGCCCTGTCCTCCATGCAAATGCCCAG<br>CACCTAACCTCTTGGGTGGACCATCCGTCTTC<br>ATCTTCCCTCCAAAGATCAAGGATGTACTCA<br>TGATCTCCCTGAGCCCCATAGTCACATGTGT<br>GGTGGTGGATGTGAGCGAGGATGACCCAGAT<br>GTCCAGATCAGCTGGTTTGTGAACAACGTGG<br>AAGTACACACAGCTCAGACACAAACCCATAG<br>AGAGGATTACAACAGTACTCTCCGGGTGGTC<br>AGTGCCCTCCCCATCCAGCACCAGGACTGGA<br>TGAGTGGCAAGGAGTTCAAATGCAAGGTCAA<br>CAACAAAGACCTCCCAGCGCCCATCGAGAGA<br>ACCATCTCAAAACCCAAAGGGTCAGTAAGAG<br>CTCCACAGGTATATGTCTTGCCTCCACCAGA<br>AGAAGAGATGACTAAGAAACAGGTCACTCT<br>GACCTGCATGGTCACAGACTTCATGCCTGAA<br>GACATTTACGTGGAGTGGACCAACAACGGGA<br>AAACAGAGCTAAACTACAAGAACACTGAAC<br>CAGTCCTGGACTCTGATGGTTCTTACTTCATG<br>TACAGCAAGCTGAGAGTGGAAAAGAAGAAC<br>TGGGTGGAAAGAAATAGCTACTCCTGTTCAG<br>TGGTCCACGAGGGTCTGCACAATCACCACAC<br>GACTAAGAGCTTCTCCCGGACTCCGGGTAAA | 862 |
| 5M1B264 | pDR000030234 | GAAGTCCAGCTGCAGCAGAGCGGAGCCGAA<br>CTCGTCAGACCTGGCGCTTCCGTGAAGCTGA<br>GCTGCACCACCAGCGGCTTCAACATCAAGGA<br>CAGCCTGATCTACTGGGTCAAGCAGCGGCCC<br>GAGCAGGGCCTGGAATGGATCGGCTGGATTG<br>ACCCCGAGGACGGCGAGACAAAGTTCGCCCC<br>TAGATTCCAGGACAAGGCCACCATCACCAGC<br>GACACCAGCAGCAACACCGCCTACCTGAGAC<br>TGAGCAGCCTGACCAGCGAGGACACCGCCAT<br>CTACTACTGCACCCGGTCCTTCGGCGTGTGTT<br>GGGGCCAGGGAACCCTGGTCACAGTGTCTGC<br>TGCCAAAACAACAGCACCAAGTGTCTATCCA<br>CTGGCCCCTGTGTGTGGAGATACAACTGGCT<br>CCTCGGTGACTCTAGGATGCCTGGTCAAGGG<br>TTATTTCCCTGAGCCAGTGACCTTGACCTGGA<br>ACTCTGGATCCCTGTCCAGTGGTGTGCACAC<br>CTTCCCAGCTGTCCTGCAGTCTGACCTCTACA<br>CCCTCAGCAGCTCAGTGACTGTAACCTCGAG<br>CACCTGGCCCAGCCAGTCCATCACCTGCAAT<br>GTGGCCCACCCGGCAAGCAGCACCAAGGTG<br>GACAAGAAAATTGAGCCCAGAGGGCCCACA<br>ATCAAGCCCTGTCCTCCATGCAAATGCCCAG<br>CACCTAACCTCTTGGGTGGACCATCCGTCTTC<br>ATCTTCCCTCCAAAGATCAAGGATGTACTCA<br>TGATCTCCCTGAGCCCCATAGTCACATGTGT<br>GGTGGTGGATGTGAGCGAGGATGACCCAGAT | 863 |

TABLE 26-continued

LukAB Antibody Heavy Chain CDSs

| mAb/Fab name | Construct ID | Heavy Chain CDS | SEQ ID NO: |
|---|---|---|---|
| | | GTCCAGATCAGCTGGTTTGTGAACAACGTGG<br>AAGTACACACAGCTCAGACACAAACCCATAG<br>AGAGGATTACAACAGTACTCTCCGGGTGGTC<br>AGTGCCCTCCCCATCCAGCACCAGGACTGGA<br>TGAGTGGCAAGGAGTTCAAATGCAAGGTCAA<br>CAACAAAGACCTCCCAGCGCCCATCGAGAGA<br>ACCATCTCAAAACCCAAAGGGTCAGTAAGAG<br>CTCCACAGGTATATGTCTTGCCTCCACCAGA<br>AGAAGAGATGACTAAGAAACAGGTCACTCT<br>GACCTGCATGGTCACAGACTTCATGCCTGAA<br>GACATTTACGTGGAGTGGACCAACAACGGGA<br>AAACAGAGCTAAACTACAAGAACACTGAAC<br>CAGTCCTGGACTCTGATGGTTCTTACTTCATG<br>TACAGCAAGCTGAGAGTGGAAAAGAAGAAC<br>TGGGTGGAAAGAAATAGCTACTCCTGTTCAG<br>TGGTCCACGAGGGTCTGCACAATCACCACAC<br>GACTAAGAGCTTCTCCCGGACTCCGGGTAAA | |
| 5M1B265 | pDR000030234 | GAAGTCCAGCTGCAGCAGAGCGGAGCCGAA<br>CTCGTCAGACCTGGCGCTTCCGTGAAGCTGA<br>GCTGCACCACCAGCGGCTTCAACATCAAGGA<br>CAGCCTGATCTACTGGGTCAAGCAGCGGCCC<br>GAGCAGGGCCTGGAATGGATCGGCTGGATTG<br>ACCCCGAGGACGGCGAGACAAAGTTCGCCCC<br>TAGATTCCAGGACAAGGCCACCATCACCAGC<br>GACACCAGCAGCAACACCGCCTACCTGAGAC<br>TGAGCAGCCTGACCAGCGAGGACACCGCCAT<br>CTACTACTGCACCCGGTCCTTCGGCGTGTGTT<br>GGGGCCAGGGAACCCTGGTCACAGTGTCTGC<br>TGCCAAAACAACAGCACCAAGTGTCTATCCA<br>CTGGCCCCTGTGTGTGGAGATACAACTGGCT<br>CCTCGGTGACTCTAGGATGCCTGGTCAAGGG<br>TTATTTCCCTGAGCCAGTGACCTTGACCTGGA<br>ACTCTGGATCCCTGTCCAGTGGTGTGCACAC<br>CTTCCCAGCTGTCCTGCAGTCTGACCTCTACA<br>CCCTCAGCAGCTCAGTGACTGTAACCTCGAG<br>CACCTGGCCCAGCCAGTCCATCACCTGCAAT<br>GTGGCCCACCCGGCAAGCAGCACCAAGGTG<br>GACAAGAAAATTGAGCCCAGAGGGCCCACA<br>ATCAAGCCCTGTCCTCCATGCAAATGCCCAG<br>CACCTAACCTCTTGGGTGGACCATCCGTCTTC<br>ATCTTCCCTCCAAAGATCAAGGATGTACTCA<br>TGATCTCCCTGAGCCCCATAGTCACATGTGT<br>GGTGGTGGATGTGAGCGAGGATGACCCAGAT<br>GTCCAGATCAGCTGGTTTGTGAACAACGTGG<br>AAGTACACACAGCTCAGACACAAACCCATAG<br>AGAGGATTACAACAGTACTCTCCGGGTGGTC<br>AGTGCCCTCCCCATCCAGCACCAGGACTGGA<br>TGAGTGGCAAGGAGTTCAAATGCAAGGTCAA<br>CAACAAAGACCTCCCAGCGCCCATCGAGAGA<br>ACCATCTCAAAACCCAAAGGGTCAGTAAGAG<br>CTCCACAGGTATATGTCTTGCCTCCACCAGA<br>AGAAGAGATGACTAAGAAACAGGTCACTCT<br>GACCTGCATGGTCACAGACTTCATGCCTGAA<br>GACATTTACGTGGAGTGGACCAACAACGGGA<br>AAACAGAGCTAAACTACAAGAACACTGAAC<br>CAGTCCTGGACTCTGATGGTTCTTACTTCATG<br>TACAGCAAGCTGAGAGTGGAAAAGAAGAAC<br>TGGGTGGAAAGAAATAGCTACTCCTGTTCAG<br>TGGTCCACGAGGGTCTGCACAATCACCACAC<br>GACTAAGAGCTTCTCCCGGACTCCGGGTAAA | 864 |
| 5M1B266 | pDR000030234 | GAAGTCCAGCTGCAGCAGAGCGGAGCCGAA<br>CTCGTCAGACCTGGCGCTTCCGTGAAGCTGA<br>GCTGCACCACCAGCGGCTTCAACATCAAGGA<br>CAGCCTGATCTACTGGGTCAAGCAGCGGCCC<br>GAGCAGGGCCTGGAATGGATCGGCTGGATTG<br>ACCCCGAGGACGGCGAGACAAAGTTCGCCCC<br>TAGATTCCAGGACAAGGCCACCATCACCAGC<br>GACACCAGCAGCAACACCGCCTACCTGAGAC<br>TGAGCAGCCTGACCAGCGAGGACACCGCCAT<br>CTACTACTGCACCCGGTCCTTCGGCGTGTGTT<br>GGGGCCAGGGAACCCTGGTCACAGTGTCTGC<br>TGCCAAAACAACAGCACCAAGTGTCTATCCA<br>CTGGCCCCTGTGTGTGGAGATACAACTGGCT | 865 |

TABLE 26-continued

LukAB Antibody Heavy Chain CDSs

| mAb/Fab name | Construct ID | Heavy Chain CDS | SEQ ID NO: |
|---|---|---|---|
| | | CCTCGGTGACTCTAGGATGCCTGGTCAAGGG<br>TTATTTCCCTGAGCCAGTGACCTTGACCTGGA<br>ACTCTGGATCCCTGTCCAGTGGTGTGCACAC<br>CTTCCCAGCTGTCCTGCAGTCTGACCTCTACA<br>CCCTCAGCAGCTCAGTGACTGTAACCTCGAG<br>CACCTGGCCCAGCCAGTCCATCACCTGCAAT<br>GTGGCCCACCCGGCAAGCAGCACCAAGGTG<br>GACAAGAAAATTGAGCCCAGAGGGCCCACA<br>ATCAAGCCCTGTCCTCCATGCAAATGCCCAG<br>CACCTAACCTCTTGGGTGGACCATCCGTCTTC<br>ATCTTCCCTCCAAAGATCAAGGATGTACTCA<br>TGATCTCCCTGAGCCCCATAGTCACATGTGT<br>GGTGGTGGATGTGAGCGAGGATGACCCAGAT<br>GTCCAGATCAGCTGGTTTGTGAACAACGTGG<br>AAGTACACACAGCTCAGACACAAACCCATAG<br>AGAGGATTACAACAGTACTCTCCGGGTGGTC<br>AGTGCCCTCCCCATCCAGCACCAGGACTGGA<br>TGAGTGGCAAGGAGTTCAAATGCAAGGTCAA<br>CAACAAAGACCTCCCAGCGCCCATCGAGAGA<br>ACCATCTCAAAACCCAAAGGGTCAGTAAGAG<br>CTCCACAGGTATATGTCTTGCCTCCACCAGA<br>AGAAGAGATGACTAAGAAACAGGTCACTCT<br>GACCTGCATGGTCACAGACTTCATGCCTGAA<br>GACATTTACGTGGAGTGGACCAACAACGGGA<br>AAACAGAGCTAAACTACAAGAACACTGAAC<br>CAGTCCTGGACTCTGATGGTTCTTACTTCATG<br>TACAGCAAGCTGAGAGTGGAAAAGAAGAAC<br>TGGGTGGAAAGAAATAGCTACTCCTGTTCAG<br>TGGTCCACGAGGGTCTGCACAATCACCACAC<br>GACTAAGAGCTTCTCCCGGACTCCGGGTAAA | |
| 5M1B267 | pDR000030234 | GAAGTCCAGCTGCAGCAGAGCGGAGCCGAA<br>CTCGTCAGACCTGGCGCTTCCGTGAAGCTGA<br>GCTGCACCACCAGCGGCTTCAACATCAAGGA<br>CAGCCTGATCTACTGGGTCAAGCAGCGGCCC<br>GAGCAGGGCCTGGAATGGATCGGCTGGATTG<br>ACCCCGAGGACGGCGAGACAAAGTTCGCCCC<br>TAGATTCCAGGACAAGGCCACCATCACCAGC<br>GACACCAGCAGCAACACCGCCTACCTGAGAC<br>TGAGCAGCCTGACCAGCGAGGACACCGCCAT<br>CTACTACTGCACCCGGTCCTTCGGCGTGTGTT<br>GGGGCCAGGGAACCCTGGTCACAGTGTCTGC<br>TGCCAAAACAACAGCACCAAGTGTCTATCCA<br>CTGGCCCCTGTGTGTGGAGATACAACTGGCT<br>CCTCGGTGACTCTAGGATGCCTGGTCAAGGG<br>TTATTTCCCTGAGCCAGTGACCTTGACCTGGA<br>ACTCTGGATCCCTGTCCAGTGGTGTGCACAC<br>CTTCCCAGCTGTCCTGCAGTCTGACCTCTACA<br>CCCTCAGCAGCTCAGTGACTGTAACCTCGAG<br>CACCTGGCCCAGCCAGTCCATCACCTGCAAT<br>GTGGCCCACCCGGCAAGCAGCACCAAGGTG<br>GACAAGAAAATTGAGCCCAGAGGGCCCACA<br>ATCAAGCCCTGTCCTCCATGCAAATGCCCAG<br>CACCTAACCTCTTGGGTGGACCATCCGTCTTC<br>ATCTTCCCTCCAAAGATCAAGGATGTACTCA<br>TGATCTCCCTGAGCCCCATAGTCACATGTGT<br>GGTGGTGGATGTGAGCGAGGATGACCCAGAT<br>GTCCAGATCAGCTGGTTTGTGAACAACGTGG<br>AAGTACACACAGCTCAGACACAAACCCATAG<br>AGAGGATTACAACAGTACTCTCCGGGTGGTC<br>AGTGCCCTCCCCATCCAGCACCAGGACTGGA<br>TGAGTGGCAAGGAGTTCAAATGCAAGGTCAA<br>CAACAAAGACCTCCCAGCGCCCATCGAGAGA<br>ACCATCTCAAAACCCAAAGGGTCAGTAAGAG<br>CTCCACAGGTATATGTCTTGCCTCCACCAGA<br>AGAAGAGATGACTAAGAAACAGGTCACTCT<br>GACCTGCATGGTCACAGACTTCATGCCTGAA<br>GACATTTACGTGGAGTGGACCAACAACGGGA<br>AAACAGAGCTAAACTACAAGAACACTGAAC<br>CAGTCCTGGACTCTGATGGTTCTTACTTCATG<br>TACAGCAAGCTGAGAGTGGAAAAGAAGAAC<br>TGGGTGGAAAGAAATAGCTACTCCTGTTCAG<br>TGGTCCACGAGGGTCTGCACAATCACCACAC<br>GACTAAGAGCTTCTCCCGGACTCCGGGTAAA | 866 |

TABLE 26-continued

LukAB Antibody Heavy Chain CDSs

| mAb/Fab name | Construct ID | Heavy Chain CDS | SEQ ID NO: |
|---|---|---|---|
| 5M1B268 | pDR000030234 | GAAGTCCAGCTGCAGCAGAGCGGAGCCGAA CTCGTCAGACCTGGCGCTTCCGTGAAGCTGA GCTGCACCACCAGCGGCTTCAACATCAAGGA CAGCCTGATCTACTGGGTCAAGCAGCGGCCC GAGCAGGGCCTGGAATGGATCGGCTGGATTG ACCCCGAGGACGGCGAGACAAAGTTCGCCCC TAGATTCCAGGACAAGGCCACCATCACCAGC GACACCAGCAGCAACACCGCCTACCTGAGAC TGAGCAGCCTGACCAGCGAGGACACCGCCAT CTACTACTGCACCCGGTCCTTCGGCGTGTGTT GGGGCCAGGGAACCCTGGTCACAGTGTCTGC TGCCAAAACAACAGCACCAAGTGTCTATCCA CTGGCCCCTGTGTGTGGAGATACAACTGGCT CCTCGGTGACTCTAGGATGCCTGGTCAAGGG TTATTTCCCTGAGCCAGTGACCTTGACCTGGA ACTCTGGATCCCTGTCCAGTGGTGTGCACAC CTTCCCAGCTGTCCTGCAGTCTGACCTCTACA CCCTCAGCAGCTCAGTGACTGTAACCTCGAG CACCTGGCCCAGCCAGTCCATCACCTGCAAT GTGGCCCACCCGGCAAGCAGCACCAAGGTG GACAAGAAAATTGAGCCCAGAGGGCCCACA ATCAAGCCCTGTCCTCCATGCAAATGCCCAG CACCTAACCTCTTGGGTGGACCATCCGTCTTC ATCTTCCCTCCAAAGATCAAGGATGTACTCA TGATCTCCCTGAGCCCCATAGTCACATGTGT GGTGGTGGATGTGAGCGAGGATGACCCAGAT GTCCAGATCAGCTGGTTTGTGAACAACGTGG AAGTACACAGCTCAGACACAAACCCATAG AGAGGATTACAACAGTACTCTCCGGGTGGTC AGTGCCCTCCCCATCCAGCACCAGGACTGGA TGAGTGGCAAGGAGTTCAAATGCAAGGTCAA CAACAAAGACCTCCCAGCGCCCATCGAGAGA ACCATCTCAAAACCCAAAGGGTCAGTAAGAG CTCCACAGGTATATGTCTTGCCTCCACCAGA AGAAGAGATGACTAAGAAACAGGTCACTCT GACCTGCATGGTCACAGACTTCATGCCTGAA GACATTTACGTGGAGTGGACCAACAACGGGA AAACAGAGCTAAACTACAAGAACACTGAAC CAGTCCTGGACTCTGATGGTTCTTACTTCATG TACAGCAAGCTGAGAGTGGAAAAGAAGAAC TGGGTGGAAAGAAATAGCTACTCCTGTTCAG TGGTCCACGAGGGTCTGCACAATCACCACAC GACTAAGAGCTTCTCCCGGACTCCGGGTAAA | 867 |
| 5M1B269 | pDR000030234 | GAAGTCCAGCTGCAGCAGAGCGGAGCCGAA CTCGTCAGACCTGGCGCTTCCGTGAAGCTGA GCTGCACCACCAGCGGCTTCAACATCAAGGA CAGCCTGATCTACTGGGTCAAGCAGCGGCCC GAGCAGGGCCTGGAATGGATCGGCTGGATTG ACCCCGAGGACGGCGAGACAAAGTTCGCCCC TAGATTCCAGGACAAGGCCACCATCACCAGC GACACCAGCAGCAACACCGCCTACCTGAGAC TGAGCAGCCTGACCAGCGAGGACACCGCCAT CTACTACTGCACCCGGTCCTTCGGCGTGTGTT GGGGCCAGGGAACCCTGGTCACAGTGTCTGC TGCCAAAACAACAGCACCAAGTGTCTATCCA CTGGCCCCTGTGTGTGGAGATACAACTGGCT CCTCGGTGACTCTAGGATGCCTGGTCAAGGG TTATTTCCCTGAGCCAGTGACCTTGACCTGGA ACTCTGGATCCCTGTCCAGTGGTGTGCACAC CTTCCCAGCTGTCCTGCAGTCTGACCTCTACA CCCTCAGCAGCTCAGTGACTGTAACCTCGAG CACCTGGCCCAGCCAGTCCATCACCTGCAAT GTGGCCCACCCGGCAAGCAGCACCAAGGTG GACAAGAAAATTGAGCCCAGAGGGCCCACA ATCAAGCCCTGTCCTCCATGCAAATGCCCAG CACCTAACCTCTTGGGTGGACCATCCGTCTTC ATCTTCCCTCCAAAGATCAAGGATGTACTCA TGATCTCCCTGAGCCCCATAGTCACATGTGT GGTGGTGGATGTGAGCGAGGATGACCCAGAT GTCCAGATCAGCTGGTTTGTGAACAACGTGG AAGTACACAGCTCAGACACAAACCCATAG AGAGGATTACAACAGTACTCTCCGGGTGGTC AGTGCCCTCCCCATCCAGCACCAGGACTGGA TGAGTGGCAAGGAGTTCAAATGCAAGGTCAA | 868 |

TABLE 26-continued

LukAB Antibody Heavy Chain CDSs

| mAb/Fab name | Construct ID | Heavy Chain CDS | SEQ ID NO: |
|---|---|---|---|
| | | CAACAAAGACCTCCCAGCGCCCATCGAGAGA<br>ACCATCTCAAAACCCAAAGGGTCAGTAAGAG<br>CTCCACAGGTATATGTCTTGCCTCCACCAGA<br>AGAAGAGATGACTAAGAAACAGGTCACTCT<br>GACCTGCATGGTCACAGACTTCATGCCTGAA<br>GACATTTACGTGGAGTGGACCAACAACGGGA<br>AAACAGAGCTAAACTACAAGAACACTGAAC<br>CAGTCCTGGACTCTGATGGTTCTTACTTCATG<br>TACAGCAAGCTGAGAGTGGAAAAGAAGAAC<br>TGGGTGGAAAGAAATAGCTACTCCTGTTCAG<br>TGGTCCACGAGGGTCTGCACAATCACCACAC<br>GACTAAGAGCTTCTCCCGGACTCCGGGTAAA | |
| 5M1B270 | pDR000030234 | GAAGTCCAGCTGCAGCAGAGCGGAGCCGAA<br>CTCGTCAGACCTGGCGCTTCCGTGAAGCTGA<br>GCTGCACCACCAGCGGCTTCAACATCAAGGA<br>CAGCCTGATCTACTGGGTCAAGCAGCGGCCC<br>GAGCAGGGCCTGGAATGGATCGGCTGGATTG<br>ACCCCGAGGACGGCGAGACAAAGTTCGCCCC<br>TAGATTCCAGGACAAGGCCACCATCACCAGC<br>GACACCAGCAGCAACACCGCCTACCTGAGAC<br>TGAGCAGCCTGACCAGCGAGGACACCGCCAT<br>CTACTACTGCACCCGGTCCTTCGGCGTGTGTT<br>GGGGCCAGGGAACCCTGGTCACAGTGTCTGC<br>TGCCAAAACAACAGCACCAAGTGTCTATCCA<br>CTGGCCCCTGTGTGTGGAGATACAACTGGCT<br>CCTCGGTGACTCTAGGATGCCTGGTCAAGGG<br>TTATTTCCCTGAGCCAGTGACCTTGACCTGGA<br>ACTCTGGATCCCTGTCCAGTGGTGTGCACAC<br>CTTCCCAGCTGTCCTGCAGTCTGACCTCTACA<br>CCCTCAGCAGCTCAGTGACTGTAACCTCGAG<br>CACCTGGCCCAGCCAGTCCATCACCTGCAAT<br>GTGGCCCACCCGGCAAGCAGCACCAAGGTG<br>GACAAGAAAATTGAGCCCAGAGGGCCCACA<br>ATCAAGCCCTGTCCTCCATGCAAATGCCCAG<br>CACCTAACCTCTTGGGTGGACCATCCGTCTTC<br>ATCTTCCCTCCAAAGATCAAGGATGTACTCA<br>TGATCTCCCTGAGCCCCATAGTCACATGTGT<br>GGTGGTGGATGTGAGCGAGGATGACCCAGAT<br>GTCCAGATCAGCTGGTTTGTGAACAACGTGG<br>AAGTACACACAGCTCAGACACAAACCCATAG<br>AGAGGATTACAACAGTACTCTCCGGGTGGTC<br>AGTGCCCTCCCCATCCAGCACCAGGACTGGA<br>TGAGTGGCAAGGAGTTCAAATGCAAGGTCAA<br>CAACAAAGACCTCCCAGCGCCCATCGAGAGA<br>ACCATCTCAAAACCCAAAGGGTCAGTAAGAG<br>CTCCACAGGTATATGTCTTGCCTCCACCAGA<br>AGAAGAGATGACTAAGAAACAGGTCACTCT<br>GACCTGCATGGTCACAGACTTCATGCCTGAA<br>GACATTTACGTGGAGTGGACCAACAACGGGA<br>AAACAGAGCTAAACTACAAGAACACTGAAC<br>CAGTCCTGGACTCTGATGGTTCTTACTTCATG<br>TACAGCAAGCTGAGAGTGGAAAAGAAGAAC<br>TGGGTGGAAAGAAATAGCTACTCCTGTTCAG<br>TGGTCCACGAGGGTCTGCACAATCACCACAC<br>GACTAAGAGCTTCTCCCGGACTCCGGGTAAA | 869 |
| 5M1B271 | pDR000030234 | GAAGTCCAGCTGCAGCAGAGCGGAGCCGAA<br>CTCGTCAGACCTGGCGCTTCCGTGAAGCTGA<br>GCTGCACCACCAGCGGCTTCAACATCAAGGA<br>CAGCCTGATCTACTGGGTCAAGCAGCGGCCC<br>GAGCAGGGCCTGGAATGGATCGGCTGGATTG<br>ACCCCGAGGACGGCGAGACAAAGTTCGCCCC<br>TAGATTCCAGGACAAGGCCACCATCACCAGC<br>GACACCAGCAGCAACACCGCCTACCTGAGAC<br>TGAGCAGCCTGACCAGCGAGGACACCGCCAT<br>CTACTACTGCACCCGGTCCTTCGGCGTGTGTT<br>GGGGCCAGGGAACCCTGGTCACAGTGTCTGC<br>TGCCAAAACAACAGCACCAAGTGTCTATCCA<br>CTGGCCCCTGTGTGTGGAGATACAACTGGCT<br>CCTCGGTGACTCTAGGATGCCTGGTCAAGGG<br>TTATTTCCCTGAGCCAGTGACCTTGACCTGGA<br>ACTCTGGATCCCTGTCCAGTGGTGTGCACAC<br>CTTCCCAGCTGTCCTGCAGTCTGACCTCTACA<br>CCCTCAGCAGCTCAGTGACTGTAACCTCGAG | 870 |

TABLE 26-continued

LukAB Antibody Heavy Chain CDSs

| mAb/Fab name | Construct ID | Heavy Chain CDS | SEQ ID NO: |
|---|---|---|---|
| | | CACCTGGCCCAGCCAGTCCATCACCTGCAAT<br>GTGGCCCACCCGGCAAGCAGCACCAAGGTG<br>GACAAGAAAATTGAGCCCAGAGGGCCCACA<br>ATCAAGCCCTGTCCTCCATGCAAATGCCCAG<br>CACCTAACCTCTTGGGTGGACCATCCGTCTTC<br>ATCTTCCCTCCAAAGATCAAGGATGTACTCA<br>TGATCTCCCTGAGCCCCATAGTCACATGTGT<br>GGTGGTGGATGTGAGCGAGGATGACCCAGAT<br>GTCCAGATCAGCTGGTTTGTGAACAACGTGG<br>AAGTACACACAGCTCAGACACAAACCCATAG<br>AGAGGATTACAACAGTACTCTCCGGGTGGTC<br>AGTGCCCTCCCCATCCAGCACCAGGACTGGA<br>TGAGTGGCAAGGAGTTCAAATGCAAGGTCAA<br>CAACAAAGACCTCCCAGCGCCCATCGAGAGA<br>ACCATCTCAAAACCCAAAGGGTCAGTAAGAG<br>CTCCACAGGTATATGTCTTGCCTCCACCAGA<br>AGAAGAGATGACTAAGAAACAGGTCACTCT<br>GACCTGCATGGTCACAGACTTCATGCCTGAA<br>GACATTTACGTGGAGTGGACCAACAACGGGA<br>AAACAGAGCTAAACTACAAGAACACTGAAC<br>CAGTCCTGGACTCTGATGGTTCTTACTTCATG<br>TACAGCAAGCTGAGAGTGGAAAAGAAGAAC<br>TGGGTGGAAAGAAATAGCTACTCCTGTTCAG<br>TGGTCCACGAGGGTCTGCACAATCACCACAC<br>GACTAAGAGCTTCTCCCGGACTCCGGGTAAA | |
| 5M1B272 | pDR000030234 | GAAGTCCAGCTGCAGCAGAGCGGAGCCGAA<br>CTCGTCAGACCTGGCGCTTCCGTGAAGCTGA<br>GCTGCACCACCAGCGGCTTCAACATCAAGGA<br>CAGCCTGATCTACTGGGTCAAGCAGCGGCCC<br>GAGCAGGGCCTGGAATGGATCGGCTGGATTG<br>ACCCCGAGGACGGCGAGACAAAGTTCGCCCC<br>TAGATTCCAGGACAAGGCCACCATCACCAGC<br>GACACCAGCAGCAACACCGCCTACCTGAGAC<br>TGAGCAGCCTGACCAGCGAGGACACCGCCAT<br>CTACTACTGCACCCGGTCCTTCGGCGTGTGTT<br>GGGGCCAGGGAACCCTGGTCACAGTGTCTGC<br>TGCCAAAACAACAGCACCAAGTGTCTATCCA<br>CTGGCCCCTGTGTGTGGAGATACAACTGGCT<br>CCTCGGTGACTCTAGGATGCCTGGTCAAGGG<br>TTATTTCCCTGAGCCAGTGACCTTGACCTGGA<br>ACTCTGGATCCCTGTCCAGTGGTGTGCACAC<br>CTTCCCAGCTGTCCTGCAGTCTGACCTCTACA<br>CCCTCAGCAGCTCAGTGACTGTAACCTCGAG<br>CACCTGGCCCAGCCAGTCCATCACCTGCAAT<br>GTGGCCCACCCGGCAAGCAGCACCAAGGTG<br>GACAAGAAAATTGAGCCCAGAGGGCCCACA<br>ATCAAGCCCTGTCCTCCATGCAAATGCCCAG<br>CACCTAACCTCTTGGGTGGACCATCCGTCTTC<br>ATCTTCCCTCCAAAGATCAAGGATGTACTCA<br>TGATCTCCCTGAGCCCCATAGTCACATGTGT<br>GGTGGTGGATGTGAGCGAGGATGACCCAGAT<br>GTCCAGATCAGCTGGTTTGTGAACAACGTGG<br>AAGTACACACAGCTCAGACACAAACCCATAG<br>AGAGGATTACAACAGTACTCTCCGGGTGGTC<br>AGTGCCCTCCCCATCCAGCACCAGGACTGGA<br>TGAGTGGCAAGGAGTTCAAATGCAAGGTCAA<br>CAACAAAGACCTCCCAGCGCCCATCGAGAGA<br>ACCATCTCAAAACCCAAAGGGTCAGTAAGAG<br>CTCCACAGGTATATGTCTTGCCTCCACCAGA<br>AGAAGAGATGACTAAGAAACAGGTCACTCT<br>GACCTGCATGGTCACAGACTTCATGCCTGAA<br>GACATTTACGTGGAGTGGACCAACAACGGGA<br>AAACAGAGCTAAACTACAAGAACACTGAAC<br>CAGTCCTGGACTCTGATGGTTCTTACTTCATG<br>TACAGCAAGCTGAGAGTGGAAAAGAAGAAC<br>TGGGTGGAAAGAAATAGCTACTCCTGTTCAG<br>TGGTCCACGAGGGTCTGCACAATCACCACAC<br>GACTAAGAGCTTCTCCCGGACTCCGGGTAAA | 871 |
| 5M1B273 | pDR000030234 | GAAGTCCAGCTGCAGCAGAGCGGAGCCGAA<br>CTCGTCAGACCTGGCGCTTCCGTGAAGCTGA<br>GCTGCACCACCAGCGGCTTCAACATCAAGGA<br>CAGCCTGATCTACTGGGTCAAGCAGCGGCCC<br>GAGCAGGGCCTGGAATGGATCGGCTGGATTG | 872 |

TABLE 26-continued

LukAB Antibody Heavy Chain CDSs

| mAb/Fab name | Construct ID | Heavy Chain CDS | SEQ ID NO: |
|---|---|---|---|
| | | ACCCCGAGGACGGCGAGACAAAGTTCGCCCC<br>TAGATTCCAGGACAAGGCCACCATCACCAGC<br>GACACCAGCAGCAACACCGCCTACCTGAGAC<br>TGAGCAGCCTGACCAGCGAGGACACCGCCAT<br>CTACTACTGCACCCGGTCCTTCGGCGTGTGTT<br>GGGGCCAGGGAACCCTGGTCACAGTGTCTGC<br>TGCCAAAACAACAGCACCAAGTGTCTATCCA<br>CTGGCCCCTGTGTGTGGAGATACAACTGGCT<br>CCTCGGTGACTCTAGGATGCCTGGTCAAGGG<br>TTATTTCCCTGAGCCAGTGACCTTGACCTGGA<br>ACTCTGGATCCCTGTCCAGTGGTGTGCACAC<br>CTTCCCAGCTGTCCTGCAGTCTGACCTCTACA<br>CCCTCAGCAGCTCAGTGACTGTAACCTCGAG<br>CACCTGGCCCAGCCAGTCCATCACCTGCAAT<br>GTGGCCCACCCGGCAAGCAGCACCAAGGTG<br>GACAAGAAAATTGAGCCCAGAGGGCCCACA<br>ATCAAGCCCTGTCCTCCATGCAAATGCCCAG<br>CACCTAACCTCTTGGGTGGACCATCCGTCTTC<br>ATCTTCCCTCCAAAGATCAAGGATGTACTCA<br>TGATCTCCCTGAGCCCCATAGTCACATGTGT<br>GGTGGTGGATGTGAGCGAGGATGACCCAGAT<br>GTCCAGATCAGCTGGTTTGTGAACAACGTGG<br>AAGTACACACAGCTCAGACACAAACCCATAG<br>AGAGGATTACAACAGTACTCTCCGGGTGGTC<br>AGTGCCCTCCCCATCCAGCACCAGGACTGGA<br>TGAGTGGCAAGGAGTTCAAATGCAAGGTCAA<br>CAACAAAGACCTCCCAGCGCCCATCGAGAGA<br>ACCATCTCAAAACCCAAAGGGTCAGTAAGAG<br>CTCCACAGGTATATGTCTTGCCTCCACCAGA<br>AGAAGAGATGACTAAGAAACAGGTCACTCT<br>GACCTGCATGGTCACAGACTTCATGCCTGAA<br>GACATTTACGTGGAGTGGACCAACAACGGGA<br>AAACAGAGCTAAACTACAAGAACACTGAAC<br>CAGTCCTGGACTCTGATGGTTCTTACTTCATG<br>TACAGCAAGCTGAGAGTGGAAAAGAAGAAC<br>TGGGTGGAAAGAAATAGCTACTCCTGTTCAG<br>TGGTCCACGAGGGTCTGCACAATCACCACAC<br>GACTAAGAGCTTCTCCCGGACTCCGGGTAAA | |
| 5M1B274 | pDR000030234 | GAAGTCCAGCTGCAGCAGAGCGGAGCCGAA<br>CTCGTCAGACCTGGCGCTTCCGTGAAGCTGA<br>GCTGCACCACCAGCGGCTTCAACATCAAGGA<br>CAGCCTGATCTACTGGGTCAAGCAGCGGCCC<br>GAGCAGGGCCTGGAATGGATCGGCTGGATTG<br>ACCCCGAGGACGGCGAGACAAAGTTCGCCCC<br>TAGATTCCAGGACAAGGCCACCATCACCAGC<br>GACACCAGCAGCAACACCGCCTACCTGAGAC<br>TGAGCAGCCTGACCAGCGAGGACACCGCCAT<br>CTACTACTGCACCCGGTCCTTCGGCGTGTGTT<br>GGGGCCAGGGAACCCTGGTCACAGTGTCTGC<br>TGCCAAAACAACAGCACCAAGTGTCTATCCA<br>CTGGCCCCTGTGTGTGGAGATACAACTGGCT<br>CCTCGGTGACTCTAGGATGCCTGGTCAAGGG<br>TTATTTCCCTGAGCCAGTGACCTTGACCTGGA<br>ACTCTGGATCCCTGTCCAGTGGTGTGCACAC<br>CTTCCCAGCTGTCCTGCAGTCTGACCTCTACA<br>CCCTCAGCAGCTCAGTGACTGTAACCTCGAG<br>CACCTGGCCCAGCCAGTCCATCACCTGCAAT<br>GTGGCCCACCCGGCAAGCAGCACCAAGGTG<br>GACAAGAAAATTGAGCCCAGAGGGCCCACA<br>ATCAAGCCCTGTCCTCCATGCAAATGCCCAG<br>CACCTAACCTCTTGGGTGGACCATCCGTCTTC<br>ATCTTCCCTCCAAAGATCAAGGATGTACTCA<br>TGATCTCCCTGAGCCCCATAGTCACATGTGT<br>GGTGGTGGATGTGAGCGAGGATGACCCAGAT<br>GTCCAGATCAGCTGGTTTGTGAACAACGTGG<br>AAGTACACACAGCTCAGACACAAACCCATAG<br>AGAGGATTACAACAGTACTCTCCGGGTGGTC<br>AGTGCCCTCCCCATCCAGCACCAGGACTGGA<br>TGAGTGGCAAGGAGTTCAAATGCAAGGTCAA<br>CAACAAAGACCTCCCAGCGCCCATCGAGAGA<br>ACCATCTCAAAACCCAAAGGGTCAGTAAGAG<br>CTCCACAGGTATATGTCTTGCCTCCACCAGA<br>AGAAGAGATGACTAAGAAACAGGTCACTCT<br>GACCTGCATGGTCACAGACTTCATGCCTGAA | 873 |

TABLE 26-continued

LukAB Antibody Heavy Chain CDSs

| mAb/Fab name | Construct ID | Heavy Chain CDS | SEQ ID NO: |
|---|---|---|---|
| | | GACATTTACGTGGAGTGGACCAACAACGGGA AAACAGAGCTAAACTACAAGAACACTGAAC CAGTCCTGGACTCTGATGGTTCTTACTTCATG TACAGCAAGCTGAGAGTGGAAAAGAAGAAC TGGGTGGAAAGAAATAGCTACTCCTGTTCAG TGGTCCACGAGGGTCTGCACAATCACCACAC GACTAAGAGCTTCTCCCGGACTCCGGGTAAA | |
| 5M1B275 | pDR000030234 | GAAGTCCAGCTGCAGCAGAGCGGAGCCGAA CTCGTCAGACCTGGCGCTTCCGTGAAGCTGA GCTGCACCACCAGCGGCTTCAACATCAAGGA CAGCCTGATCTACTGGGTCAAGCAGCGGCCC GAGCAGGGCCTGGAATGGATCGGCTGGATTG ACCCCGAGGACGGCGAGACAAAGTTCGCCCC TAGATTCCAGGACAAGGCCACCATCACCAGC GACACCAGCAGCAACACCGCCTACCTGAGAC TGAGCAGCCTGACCAGCGAGGACACCGCCAT CTACTACTGCACCCGGTCCTTCGGCGTGTGTT GGGGCCAGGGAACCCTGGTCACAGTGTCTGC TGCCAAAACAACAGCACCAAGTGTCTATCCA CTGGCCCCTGTGTGTGGAGATACAACTGGCT CCTCGGTGACTCTAGGATGCCTGGTCAAGGG TTATTTCCCTGAGCCAGTGACCTTGACCTGGA ACTCTGGATCCCTGTCCAGTGGTGTGCACAC CTTCCCAGCTGTCCTGCAGTCTGACCTCTACA CCCTCAGCAGCTCAGTGACTGTAACCTCGAG CACCTGGCCCAGCCAGTCCATCACCTGCAAT GTGGCCCACCCGGCAAGCAGCACCAAGGTG GACAAGAAAATTGAGCCCAGAGGGCCCACA ATCAAGCCCTGTCCTCCATGCAAATGCCCAG CACCTAACCTCTTGGGTGGACCATCCGTCTTC ATCTTCCCTCCAAAGATCAAGGATGTACTCA TGATCTCCCTGAGCCCCATAGTCACATGTGT GGTGGTGGATGTGAGCGAGGATGACCCAGAT GTCCAGATCAGCTGGTTTGTGAACAACGTGG AAGTACACACAGCTCAGACACAAACCCATAG AGAGGATTACAACAGTACTCTCCGGGTGGTC AGTGCCCTCCCCATCCAGCACCAGGACTGGA TGAGTGGCAAGGAGTTCAAATGCAAGGTCAA CAACAAAGACCTCCCAGCGCCCATCGAGAGA ACCATCTCAAAACCCAAAGGGTCAGTAAGAG CTCCACAGGTATATGTCTTGCCTCCACCAGA AGAAGAGATGACTAAGAAACAGGTCACTCT GACCTGCATGGTCACAGACTTCATGCCTGAA GACATTTACGTGGAGTGGACCAACAACGGGA AAACAGAGCTAAACTACAAGAACACTGAAC CAGTCCTGGACTCTGATGGTTCTTACTTCATG TACAGCAAGCTGAGAGTGGAAAAGAAGAAC TGGGTGGAAAGAAATAGCTACTCCTGTTCAG TGGTCCACGAGGGTCTGCACAATCACCACAC GACTAAGAGCTTCTCCCGGACTCCGGGTAAA | 874 |

TABLE 27

LukAB Antibody Heavy Chain Primary Transcripts

| mAB/Fab name | Construct ID | Heavy Chain Primary Transcript | SEQ ID NO: |
|---|---|---|---|
| SM1B105 | pDR000023596 | ATGGCTTGGGTGTGGACCTTGCTATTCCTGA TGGCAGCTGCCCAAAGTATACAGGCCGAGG TTCAGCTGCAGCAGTCTGGGGCTGAGCTGAT GACGCCTGGGGCCTCAGTGAAGATATCCTGC AAGGCTACTGGCTACACATTCAGTACCTTTT GGATAGAGTGGATCAAGCAGAGGCCTGGAC ATGGCCTTGAGTGGATTGGAGAGATTTTACC TGGAAGTGGTAGTACTAAGTACAATGAGAA GTTCAAGGGCAAGGCCACATTCACTGCAGA TACATCCTCCAACACAGCCTACATGCAACTC AGCAGCCTGACATCTGAGGACTCTGCCGTCT ATTATTGTGCAAGAGGTGGTTACGATGGTAT GGACTACTGGGGTCAAGGAACCCTCAGTCAC | 875 |

TABLE 27-continued

LukAB Antibody Heavy Chain Primary Transcripts

| mAB/<br>Fab name | Con-<br>struct ID | Heavy Chain Primary Transcript | SEQ ID NO: |
|---|---|---|---|
| | | CGTCTCCTCAGCCAAAACGACACCCCCATCT<br>GTCTATCCACTGGCCCCTGGATCTGCTGCCC<br>AAACTAACTCCATGGTGACCCTGGGATGCCT<br>GGTCAAGGGCTATTTCCCTGAGCCAGTGACA<br>GTGACCTGGAACTCTGGATCCCTGTCCAGCG<br>GTGTGCACACCTTCCCAGCTGTCCTGGAGTC<br>TGACCTCTACACTCTGAGCAGCTCAGTGACT<br>GTCCCCTCCAGCCCTCGGCCCAGCGAGACCG<br>TCACCTGCAACGTTGCCCACCCGGCCAGCAG<br>CACCAAGGTGGACAAGAAAATTGTGCCCAG<br>GGATTGTGGTTGTAAGCCTTGCATATGTACA<br>GTCCCAGAAGTATCATCTGTCTTCATCTTCC<br>CCCCAAAGCCCAAGGATGTGCTCACCATTAC<br>TCTGACTCCTAAGGTCACGTGTGTTGTGGTA<br>GACATCAGCAAGGATGATCCCGAGGTCCAG<br>TTCAGCTGGTTTGTAGATGATGTGGAGGTGC<br>ACACAGCTCAGACGCAACCCCGGGAGGAGC<br>AGTTCAACAGCACTTTCCGCTCAGTCAGTGA<br>AAAGTCAGTCTGACCTGCATGATAACAGACT<br>TCTTCCCTGAAGACATTACTGTGGAGTGGCA<br>GTGGAATGGGCAGCCAGCGGAGAACTACAA<br>GAACACTCAGCCCATCATGAACACGAATGG<br>CTCTTACTTCGTCTACAGCAAGCTCAATGTG<br>CAGAAGAGCAACTGGGAGGCAGGAAATACT<br>TTCACCTGCTCTGTGTTACATGAGGGCCTGC<br>ACAACCACCATACTGAGAAGAGCCTCTCCC<br>ACTCTCCTGGTAAATGA | |
| SM1B109 | pDR000023<br>596 | ATGGCTTGGGTGTGGACCTTGCTATTCCTGA<br>TGGCAGCTGCCCAAAGTATACAGGCCGAGG<br>TTCAGCTGCAGCAGTCTGGGGCTGAGCTGAT<br>GACGCCTGGGGCCTCAGTGAAGATATCCTGC<br>AAGGCTACTGGCTACACATTCAGTACCTTTT<br>GGATAGAGTGGATCAAGCAGAGGCCTGGAC<br>ATGGCCTTGAGTGGATTGGAGAGATTTTACC<br>TGGAAGTGGTAGTACTAAGTACAATGAGAA<br>GTTCAAGGGCAAGGCCACATTCACTGCAGA<br>TACATCCTCCAACACAGCCTACATGCAACTC<br>AGCAGCCTGACATCTGAGGACTCTGCCGTCT<br>ATTATTGTGCAAGAGGTGGTTACGATGGTAT<br>GGACTACTGGGGTCAAGGAACCTCAGTCAC<br>CGTCTCCTCAGCCAAAACGACACCCCCATCT<br>GTCTATCCACTGGCCCCTGGATCTGCTGCCC<br>AAACTAACTCCATGGTGACCCTGGGATGCCT<br>GGTCAAGGGCTATTTCCCTGAGCCAGTGACA<br>GTGACCTGGAACTCTGGATCCCTGTCCAGCG<br>GTGTGCACACCTTCCCAGCTGTCCTGGAGTC<br>TGACCTCTACACTCTGAGCAGCTCAGTGACT<br>GTCCCCTCCAGCCCTCGGCCCAGCGAGACCG<br>TCACCTGCAACGTTGCCCACCCGGCCAGCAG<br>CACCAAGGTGGACAAGAAAATTGTGCCCAG<br>GGATTGTGGTTGTAAGCCTTGCATATGTACA<br>GTCCCAGAAGTATCATCTGTCTTCATCTTCC<br>CCCCAAAGCCCAAGGATGTGCTCACCATTAC<br>TCTGACTCCTAAGGTCACGTGTGTTGTGGTA<br>GACATCAGCAAGGATGATCCCGAGGTCCAG<br>TTCAGCTGGTTTGTAGATGATGTGGAGGTGC<br>ACACAGCTCAGACGCAACCCCGGGAGGAGC<br>AGTTCAACAGCACTTTCCGCTCAGTCAGTGA<br>ACTTCCCATCATGCACCAGGACTGGCTCAAT<br>GGCAAGGAGTTCAAATGCAGGGTCAACAGT<br>GCAGCTTTCCCTGCCCCATCGAGAAAACCA<br>TCTCCAAAACCAAAGGCAGACCGAAGGCTC<br>CACAGGTGTACACCATTCCACCTCCCAAGGA<br>GCAGATGGCCAAGGATAAAGTCAGTCTGAC<br>CTGCATGATAACAGACTTCTTCCCTGAAGAC<br>ATTACTGTGGAGTGGCAGTGGAATGGGCAG<br>ACTTCCCATCATGCACCAGGACTGGCTCAAT<br>GGCAAGGAGTTCAAATGCAGGGTCAACAGT<br>GCAGCTTTCCCTGCCCCATCGAGAAAACCA<br>TCTCCAAAACCAAAGGCAGACCGAAGGCTC<br>CACAGGTGTACACCATTCCACCTCCCAAGGA<br>GCAGATGGCCAAGGATAAAGTCAGTCTGAC<br>CTGCATGATAACAGACTTCTTCCCTGAAGAC | 879 |

TABLE 27-continued

LukAB Antibody Heavy Chain Primary Transcripts

| mAB/<br>Fab name | Con-<br>struct ID | Heavy Chain Primary Transcript | SEQ ID NO: |
|---|---|---|---|
| | | ATTACTGTGGAGTGGCAGTGGAATGGGCAG<br>CCAGCGGAGAACTACAAGAACACTCAGCCC<br>ATCATGAACACGAATGGCTCTTACTTCGTCT<br>ACAGCAAGCTCAATGTGCAGAAGAGCAACT<br>GGGAGGCAGGAAATACTTTCACCTGCTCTGT<br>GTTACATGAGGGCCTGCACAACCACCATACT<br>GAGAAGAGCCTCTCCCACTCTCCTGGTAAAT<br>GA | |
| SM1B106 | pDR000023<br>618 | ATGGCTTGGGTGTGGACCTTGCTATTCCTGA<br>TGGCAGCTGCCCAAAGTATACAGGCCGAGG<br>TTCAGCTGCAGCAGTCTGGGGCTGAGCTGAT<br>GACGCCTGGGGCCTCAGTGAAGATATCCTGC<br>AAGGCTACTGGCTACACATTCAGTACCTTTT<br>GGATAGAGTGGATCAAGCAGAGGCCTGGAC<br>ATGGCCTTGAGTGGATTGGAGAGATTTTACC<br>TGGAAGTGGTAGTACTAAGTACAATGAGAA<br>GTTCAAGGGCAAGGCCACATTCACTGCAGA<br>TACATCCTCCAACACAGCCTACATGCAACTC<br>AGCAGCCTGTCATCTGAGGACTCTGCCGTCT<br>ATTATTGTGCAAGAGGTGGTTACGATGGTAT<br>GGACTACTGGGGTCAAGGAACCTCAGTCAC<br>CGTCTCCTCAGCCAAAACGACACCCCCATCT<br>GTCTATCCACTGGCCCCTGGATCTGCTGCCC<br>AAACTAACTCCATGGTGACCCTGGGATGCCT<br>GGTCAAGGGCTATTTCCCTGAGCCAGTGACA<br>GTGACCTGGAACTCTGGATCCCTGTCCAGCG<br>GTGTGCACACCTTCCCAGCTGTCCTGGAGTC<br>TGACCTCTACACTCTGAGCAGCTCAGTGACT<br>GTCCCCTCCAGCCCTCGGCCCAGCGAGACCG<br>TCACCTGCAACGTTGCCCACCCGGCCAGCAG<br>CACCAAGGTGGACAAGAAAATTGTGCCCAG<br>GGATTGTGGTTGTAAGCCTTGCATATGTACA<br>GTCCCAGAAGTATCATCTGTCTTCATCTTCC<br>CCCCAAAGCCCAAGGATGTGCTCACCATTAC<br>TCTGACTCCTAAGGTCACGTGTGTTGTGGTA<br>GACATCAGCAAGGATGATCCCGAGGTCCAG<br>TTCAGCTGGTTTGTAGATGATGTGGAGGTGC<br>ACACAGCTCAGACGCAACCCCGGGAGGAGC<br>AGTTCAACAGCACTTTCCGCTCAGTCAGTGA<br>ACTTCCCATCATGCACCAGGACTGGCTCAAT<br>GGCAAGGAGTTCAAATGCAGGGTCAACAGT<br>GCAGCTTTCCCTGCCCCCATCGAGAAAACCA<br>TCTCCAAAACCAAAGGCAGACCGAAGGCTC<br>CACAGGTGTACACCATTCCACCTCCCAAGGA<br>GCAGATGGCCAAGGATAAAGTCAGTCTGAC<br>CTGCATGATAACAGACTTCTTCCCTGAAGAC<br>ATTACTGTGGAGTGGCAGTGGAATGGGCAG<br>CCAGCGGAGAACTACAAGAACACTCAGCCC<br>ATCATGAACACGAATGGCTCTTACTTCGTCT<br>ACAGCAAGCTCAATGTGCAGAAGAGCAACT<br>GGGAGGCAGGAAATACTTTCACCTGCTCTGT<br>GTTACATGAGGGCCTGCACAACCACCATACT<br>GAGAAGAGCCTCTCCCACTCTCCTGGTAAAT<br>GA | 876 |
| SM1B107 | pDR000023<br>619 | ATGGCTTGGGTGTGGACCTTGCTATTCCTGA<br>TGGCAGCTGCCCAAAGTATACAGGCCGAGG<br>TTCAGCTGCAGCAGTCTGAGGCTGAGCTGAT<br>GACGCCTGGGGCCTCAGTGAAGATATCCTGC<br>AAGGCTACTGGCTACACATTCAGTACCTTTT<br>GGATAGAGTGGATCAAGCAGAGGCCTGGAC<br>ATGGCCTTGAGTGGATTGGAGAGATTTTACC<br>TGGAAGTGGTAGTACTAAGTACAATGAGAA<br>GTTCAAGGGCAAGGCCACATTCACTGCAGA<br>TACATCCTCCAACACAGCCTACATGCAACTC<br>AGCAGCCTGACATCTGAGGACTCTGCCGTCT<br>ATTATTGTGCAAGAGGTGGTTACGATGGTAT<br>GGACTACTGGGGTCAAGGAACCTCAGTCAC<br>CGTCTCCTCAGCCAAAACGACACCCCCATCT<br>GTCTATCCACTGGCCCCTGGATCTGCTGCCC<br>AAACTAACTCCATGGTGACCCTGGGATGCCT<br>GGTCAAGGGCTATTTCCCTGAGCCAGTGACA | 877 |

TABLE 27-continued

LukAB Antibody Heavy Chain Primary Transcripts

| mAB/<br>Fab name | Con-<br>struct ID | Heavy Chain Primary Transcript | SEQ ID NO: |
|---|---|---|---|
| | | GTGACCTGGAACTCTGGATCCCTGTCCAGCG<br>GTGTGCACACCTTCCCAGCTGTCCTGGAGTC<br>TGACCTCTACACTCTGAGCAGCTCAGTGACT<br>GTCCCCTCCAGCCCTCGGCCCAGCGAGACCG<br>TCACCTGCAACGTTGCCCACCCGGCCAGCAG<br>CACCAAGGTGGACAAGAAAATTGTGCCCAG<br>GGATTGTGGTTGTAAGCCTTGCATATGTACA<br>GTCCCAGAAGTATCATCTGTCTTCATCTTCC<br>CCCCAAAGCCCAAGGATGTGCTCACCATTAC<br>TCTGACTCCTAAGGTCACGTGTGTTGTGGTA<br>GACATCAGCAAGGATGATCCCGAGGTCCAG<br>TTCAGCTGGTTTGTAGATGATGTGGAGGTGC<br>ACACAGCTCAGACGCAACCCCGGGAGGAGC<br>AGTTCAACAGCACTTTCCGCTCAGTCAGTGA<br>ACTTCCCATCATGCACCAGGACTGGCTCAAT<br>GGCAAGGAGTTCAAATGCAGGGTCAACAGT<br>GCAGCTTTCCCTGCCCCCATCGAGAAAACCA<br>TCTCCAAAACCAAAGGCAGACCGAAGGCTC<br>CACAGGTGTACACCATTCCACCTCCCAAGGA<br>GCAGATGGCCAAGGATAAAGTCAGTCTGAC<br>CTGCATGATAACAGACTTCTTCCCTGAAGAC<br>ATTACTGTGGAGTGGCAGTGGAATGGGCAG<br>CCAGCGGAGAACTACAAGAACACTCAGCCC<br>ATCATGAACACGAATGGCTCTTACTTCGTCT<br>ACAGCAAGCTCAATGTGCAGAAGAGCAACT<br>GGGAGGCAGGAAATACTTTCACCTGCTCTGT<br>GTTACATGAGGGCCTGCACAACCACCATACT<br>GAGAAGAGCCTCTCCCACTCTCCTGGTAAAT<br>GA | |
| SM1B108 | pDR000023<br>620 | ATGGCTTGGGTGTGGACCTTGCTATTCCTGA<br>TGGCAGCTGCCCAAAGTATACAGGCCGAGG<br>TTCAGCTGCAGCAGTCTGGGGCTGAGCTGGT<br>GAAGCCTGGGGCCTCAGTGAAGATTTCCTGC<br>AAGGCTTCTGGCTATGCATTCAGTAGCTCCT<br>GGATGAACTGGGTGAAGCAGAGGCCTGGAA<br>AGGGTCTTGAGTGGATTGGACGGATTTATCC<br>TGGAGATGGAGATACTAACTACCATGGGAA<br>GTTCAAGGGCAAGGCCACACTGACTGCAGA<br>CAAATCCTCCAGCACAGCCTACATGCAACTC<br>AGCAGCCTGACATCTGAGGACTCTGCGGTCT<br>ACTTCTGTGCAAGAAGGAACTATGATGGTTA<br>CCACTATGGTATGGACTACTGGGGTCAAGG<br>AACCTCAGTCACCGTCTCCTCAGCCAAAACG<br>ACACCCCCATCTGTCTATCCACTGGCCCCTG<br>GATCTGCTGCCCAAACTAACTCCATGGTGAC<br>CCTGGGATGCCTGGTCAAGGGCTATTTCCCT<br>GAGCCAGTGACAGTGACCTGGAACTCTGGA<br>TCCCTGTCCAGCGGTGTGCACACCTTCCCAG<br>CTGTCCTGGAGTCTGACCTCTACACTCTGAG<br>CAGCTCAGTGACTGTCCCCTCCAGCCCTCGG<br>CCCAGCGAGACCGTCACCTGCAACGTTGCCC<br>ACCCGGCCAGCAGCACCAAGGTGGACAAGA<br>AAATTGTGCCCAGGGATTGTGGTTGTAAGCC<br>TTGCATATGTACAGTCCCAGAAGTATCATCT<br>GTCTTCATCTTCCCCCCAAAGCCCAAGGATG<br>TGCTCACCATTACTCTGACTCCTAAGGTCAC<br>GTGTGTTGTGGTAGACATCAGCAAGGATGAT<br>CCCGAGGTCCAGTTCAGCTGGTTTGTAGATG<br>ATGTGGAGGTGCACACAGCTCAGACGCAAC<br>CCCGGGAGGAGCAGTTCAACAGCACTTTCC<br>GCTCAGTCAGTGAACTTCCCATCATGCACCA<br>GGACTGGCTCAATGGCAAGGAGTTCAAATG<br>CAGGGTCAACAGTGCAGCTTTCCCTGCCCCC<br>ATCGAGAAAACCATCTCCAAAACCAAAGGC<br>AGACCGAAGGCTCCACAGGTGTACACCATT<br>CCACCTCCCAAGGAGCAGATGGCCAAGGAT<br>CCAGCGGAGAACTACAAGAACACTCAGCCC<br>ATCATGAACACGAATGGCTCTTACTTCGTCT<br>ACAGCAAGCTCAATGTGCAGAAGAGCAACT<br>GGGAGGCAGGAAATACTTTCACCTGCTCTGT<br>GTTACATGAGGGCCTGCACAACCACCATACT<br>GAGAAGAGCCTCTCCCACTCTCCTGGTAAAT<br>GA | 878 |

TABLE 27-continued

LukAB Antibody Heavy Chain Primary Transcripts

| mAB/Fab name | Construct ID | Heavy Chain Primary Transcript | SEQ ID NO: |
|---|---|---|---|
| SM1B110 | pDR000023622 | ATGGCTTGGGTGTGGACCTTGCTATTCCTGA<br>TGGCAGCTGCCCAAAGTATACAGGCCGAGG<br>TTCAGCTGCAGCAGTCTGGGGCTGAGCTGGT<br>CAAGCCTGGGACTTCAGTGAAGATGTCCTGC<br>AAGGCTTCTGGCTACACCTTCACCAGCTACT<br>GGATGCACTGGGTGAAACTTAGGCCTGGAC<br>AAGGCCTTGAGTGGATCGGAGTGATTGATCC<br>TTCTGATAGTTATACTAACTATAATCAAAAG<br>TTCAAGGGCAGGGCCACATTGACTGGAGAC<br>ACATCCTCCAGCACAGCCTACATGCAGCTCA<br>GCAGCCTGACATCTGAGGACTCTGCGGTCTA<br>TTACTGTACAAGAGCAGCATATGATAACTCG<br>TACTACTTTGACTACTGGGGCCAAGGCACCA<br>CTCTCACAGTCTCCTCAGCCAAAACGACACC<br>CCCATCTGTCTATCCACTGGCCCCTGGATCT<br>GCTGCCCAAACTAACTCCATGGTGACCCTGG<br>GATGCCTGGTCAAGGGCTATTTCCCTGAGCC<br>AGTGACAGTGACCTGGAACTCTGGATCCCTG<br>TCCAGCGGTGTGCACACCTTCCCAGCTGTCC<br>TGGAGTCTGACCTCTACACTCTGAGCAGCTC<br>AGTGACTGTCCCCTCCAGCCCTCGGCCCAGC<br>GAGACCGTCACCTGCAACGTTGCCCACCCGG<br>CCAGCAGCACCAAGGTGGACAAGAAAATTG<br>TGCCCAGGGATTGTGGTTGTAAGCCTTGCAT<br>ATGTACAGTCCCAGAAGTATCATCTGTCTTC<br>ATCTTCCCCCCAAAGCCCAAGGATGTGCTCA<br>CCATTACTCTGACTCCTAAGGTCACGTGTGT<br>TGTGGTAGACATCAGCAAGGATGATCCCGA<br>GGTCCAGTTCAGCTGGTTTGTAGATGATGTG<br>GAGGTGCACACAGCTCAGACGCAACCCCGG<br>GAGGAGCAGTTCAACAGCACTTTCCGCTCAG<br>TCAGTGAACTTCCCATCATGCACCAGGACTG<br>GCTCAATGGCAAGGAGTTCAAATGCAGGGT<br>CAACAGTGCAGCTTTCCCTGCCCCCATCGAG<br>AAAACCATCTCCAAAACCAAAGGCAGACCG<br>AAGGCTCCACAGGTGTACACCATTCCACCTC<br>CCAAGGAGCAGATGGCCAAGGATAAAGTCA<br>GTCTGACCTGCATGATAACAGACTTCTTCCC<br>TGAAGACATTACTGTGGAGTGGCAGTGGAA<br>TGGGCAGCCAGCGGAGAACTACAAGAACAC<br>TCAGCCCATCATGAACACGAATGGCTCTTAC<br>TTCGTCTACAGCAAGCTCAATGTGCAGAAGA<br>GCAACTGGGAGGCAGGAAATACTTTCACCT<br>GCTCTGTGTTACATGAGGGCCTGCACAACCA<br>CCATACTGAGAAGAGCCTCTCCCACTCTCCT<br>GGTAAATGA | 880 |
| SM1B111 | pDR000023624 | ATGGCTTGGGTGTGGACCTTGCTATTCCTGA<br>TGGCAGCTGCCCAAAGTATACAGGCCGAGG<br>TTCAGCTGCAGCAGTCTGGGGCTGAGCTGGT<br>GAAGCCTGGGGCCTCAGTGAAGATTTCCTGC<br>AAGGCTTCTGGCTATGCATTCAGTAGTTCCT<br>GGATGAACTGGTTGAAGCAGAGGCCTGGAA<br>AGGGTCTTGAGTGGATTGGACGGATTTATCC<br>TGGAGATGGAGATACTAATTACAATGGGAA<br>GTTCAAGGGCAAGGCCACACTGACTGCAGA<br>CAAGTCCTCCAGTACAGCCTACATGCAACTC<br>AGCAGCCTGACATCTGAGGACTCTGCGGTCT<br>ACTTCTGTGCAAGATACGGCTATGATTACGA<br>CGGGGAATATTACTATGCTATGGACTACTGG<br>GGTCAAGGAACCTCAGTCACCGTCTCCTCAG<br>CCAAAACGACACCCCCATCTGTCTATCCACT<br>GGCCCCTGGATCTGCTGCCCAAACTAACTCC<br>ATGGTGACCCTGGGATGCCTGGTCAAGGGCT<br>ATTTCCCTGAGCCAGTGACAGTGACCTGGAA<br>CTCTGGATCCCTGTCCAGCGGTGTGCACACC<br>TTCCCAGCTGTCCTGGAGTCTGACCTCTACA<br>CTCTGAGCAGCTCAGTGACTGTCCCCTCCAG<br>CCCTCGGCCCAGCGAGACCGTCACCTGCAAC<br>GTTGCCCACCCGGCCAGCAGCACCAAGGTG<br>GACAAGAAAATTGTGCCCAGGGATTGTGGT<br>TGTAAGCCTTGCATATGTACAGTCCCAGAAG | 881 |

TABLE 27-continued

LukAB Antibody Heavy Chain Primary Transcripts

| mAB/<br>Fab name | Con-<br>struct ID | Heavy Chain Primary Transcript | SEQ ID NO: |
|---|---|---|---|
| | | TATCATCTGTCTTCATCTTCCCCCCAAAGCCC<br>AAGGATGTGCTCACCATTACTCTGACTCCTA<br>AGGTCACGTGTGTTGTGGTAGACATCAGCAA<br>GGATGATCCCGAGGTCCAGTTCAGCTGGTTT<br>GTAGATGATGTGGAGGTGCACACAGCTCAG<br>ACGCAACCCCGGGAGGAGCAGTTCAACAGC<br>ACTTTCCGCTCAGTCAGTGAACTTCCCATCA<br>TGCACCAGGACTGGCTCAATGGCAAGGAGT<br>TCAAATGCAGGGTCAACAGTGCAGCTTTCCC<br>TGCCCCCATCGAGAAAACCATCTCCAAAACC<br>AAAGGCAGACCGAAGGCTCCACAGGTGTAC<br>ACCATTCCACCTCCCAAGGAGCAGATGGCC<br>AAGGATAAAGTCAGTCTGACCTGCATGATA<br>ACAGACTTCTTCCCTGAAGACATTACTGTGG<br>AGTGGCAGTGGAATGGGCAGCCAGCGGAGA<br>ACTACAAGAACACTCAGCCCATCATGAACA<br>CGAATGGCTCTTACTTCGTCTACAGCAAGCT<br>CAATGTGCAGAAGAGCAACTGGGAGGCAGG<br>AAATACTTTCACCTGCTCTGTGTTACATGAG<br>GGCCTGCACAACCACCATACTGAGAAGAGC<br>CTCTCCCACTCTCCTGGTAAATGA | |
| SM1B112 | pDR000023<br>623 | ATGGCTTGGGTGTGGACCTTGCTATTCCTGA<br>TGGCAGCTGCCCAAAGTATACAGGCCCAGG<br>TGCAGCTGAAGGAGTCAGGACCTGAACTGA<br>AGAAGCCTGGAGAGACAGTCAGGATCTCCT<br>GCAAGGCTTCTGGGTATACTTTCACAAATTA<br>TGGAATGAACTGGGTGAAGCAGACTCCAGG<br>AAAGGGTTTAAAGTGGATAGACTGGTTAAA<br>GTCCTACACTGGAGAGCCAACACATACTGGT<br>GACTTCAAGGGACGGTTTGACCTCTCTTTGG<br>AAACCTCTGCCAACACTGCCTATTTGCAGAT<br>CAACAACCTCAAAAATGAGGACACGGCTAC<br>ATATTTCTGTGCAAGAGGGTCCCTCTTTGGT<br>TTGGACTACTGGGGTCAAGGAACCTCAGTCA<br>CCGTCTCCTCAGCCAAAACGACACCCCCATC<br>TGTCTATCCACTGGCCCCTGGATCTGCTGCC<br>CAAACTAACTCCATGGTGACCCTGGGATGCC<br>TGGTCAAGGGCTATTTCCCTGAGCCAGTGAC<br>AGTGACCTGGAACTCTGGATCCCTGTCCAGC<br>GGTGTGCACACCTTCCCAGCTGTCCTGGAGT<br>CTGACCTCTACACTCTGAGCAGCTCAGTGAC<br>TGTCCCCTCCAGCCCTCGGCCCAGCGAGACC<br>GTCACCTGCAACGTTGCCCACCCGGCCAGCA<br>GCACCAAGGTGGACAAGAAAATTGTGCCCA<br>GGGATTGTGGTTGTAAGCCTTGCATATGTAC<br>AGTCCCAGAAGTATCATCTGTCTTCATCTTC<br>CCCCCAAAGCCCAAGGATGTGCTCACCATTA<br>CTCTGACTCCTAAGGTCACGTGTGTTGTGGT<br>AGACATCAGCAAGGATGATCCCGAGGTCCA<br>GTTCAGCTGGTTTGTAGATGATGTGGAGGTG<br>CACACAGCTCAGACGCAACCCCGGGAGGAG<br>CAGTTCAACAGCACTTTCCGCTCAGTCAGTG<br>AACTTCCCATCATGCACCAGGACTGGCTCAA<br>TGGCAAGGAGTTCAAATGCAGGGTCAACAG<br>TGCAGCTTTCCCTGCCCCCATCGAGAAAACC<br>ATCTCCAAAACCAAAGGCAGACCGAAGGCT<br>CCACAGGTGTACACCATTCCACCTCCCAAGG<br>AGCAGATGGCCAAGGATAAAGTCAGTCTGA<br>CCTGCATGATAACAGACTTCTTCCCTGAAGA<br>CATTACTGTGGAGTGGCAGTGGAATGGGCA<br>GCCAGCGGAGAACTACAAGAACACTCAGCC<br>CATCATGAACACGAATGGCTCTTACTTCGTC<br>TACAGCAAGCTCAATGTGCAGAAGAGCAAC<br>TGGGAGGCAGGAAATACTTTCACCTGCTCTG<br>TGTTACATGAGGGCCTGCACAACCACCATAC<br>TGAGAAGAGCCTCTCCCACTCTCCTGGTAAA<br>TGA | 882 |
| SM1B243 | pDR000030<br>109 | ATGGCTTGGGTGTGGACCTTGCTATTCCTGA<br>TGGCAGCTGCCCAAAGTATACAGGCCGAAG<br>TCCAGCTGCAGCAGAGCGGAGCCGAGCTGG<br>TCAAAAGCGGAGCCAGCGTGAAGCTGAGCT | 883 |

TABLE 27-continued

LukAB Antibody Heavy Chain Primary Transcripts

| mAB/<br>Fab name | Con-<br>struct ID | Heavy Chain Primary Transcript | SEQ ID NO: |
|---|---|---|---|
| | | GCACCGCCAGCGGCTTCAACATCAAGGACT<br>ACTACATGCACTGGGTCAAGCAGCGGCCCG<br>AGCAGGGCCTGGAATGGATCGGAAGAATCG<br>ACCCCGCCAACGGCAACACCAAATACGACC<br>CCAAGTTCCAGGACAAGGCCACCATCACCA<br>GCGACACCAGCAGCAACACCGCCTACCTGC<br>AGCTGAGCAGCCTGACCAGCGAGGACACCG<br>CCGTGTACTACTGCGCCGAGGGCGATTACGT<br>GCCCGGCTACTTTGATGTGTGGGGAGCCGGC<br>ACCACCGTGACCGTGTCATCTGCCAAAACAA<br>CAGCACCAAGTGTCTATCCACTGGCCCCTGT<br>GTGTGGAGATACAACTGGCTCCTCGGTGACT<br>CTAGGATGCCTGGTCAAGGGTTATTTCCCTG<br>AGCCAGTGACCTTGACCTGGAACTCTGGATC<br>CCTGTCCAGTGGTGTGCACACCTTCCCAGCT<br>GTCCTGCAGTCTGACCTCTACACCCTCAGCA<br>GCTCAGTGACTGTAACCTCGAGCACCTGGCC<br>CAGCCAGTCCATCACCTGCAATGTGGCCCAC<br>CCGGCAAGCAGCACCAAGGTGGACAAGAAA<br>ATTGAGCCCAGAGGGCCCACAATCAAGCCC<br>TGTCCTCCATGCAAATGCCCAGCACCTAACC<br>TCTTGGGTGGACCATCCGTCTTCATCTTCCCT<br>CCAAAGATCAAGGATGTACTCATGATCTCCC<br>TGAGCCCCATAGTCACATGTGTGGTGGTGGA<br>TGTGAGCGAGGATGACCCAGATGTCCAGAT<br>CAGCTGGTTTGTGAACAACGTGGAAGTACA<br>CACAGCTCAGACACAAACCCATAGAGAGGA<br>TTACAACAGTACTCTCCGGGTGGTCAGTGCC<br>CTCCCCATCCAGCACCAGGACTGGATGAGTG<br>GCAAGGAGTTCAAATGCAAGGTCAACAACA<br>AAGACCTCCCAGCGCCCATCGAGAGAACCA<br>TCTCAAAACCCAAAGGGTCAGTAAGAGCTC<br>CACAGGTATATGTCTTGCCTCCACCAGAAGA<br>AGAGATGACTAAGAAACAGGTCACTCTGAC<br>CTGCATGGTCACAGACTTCATGCCTGAAGAC<br>ATTTACGTGGAGTGGACCAACAACGGGAAA<br>ACAGAGCTAAACTACAAGAACACTGAACCA<br>GTCCTGGACTCTGATGGTTCTTACTTCATGT<br>ACAGCAAGCTGAGAGTGGAAAAGAAGAACT<br>GGGTGGAAAGAAATAGCTACTCCTGTTCAGT<br>GGTCCACGAGGGTCTGCACAATCACCACAC<br>GACTAAGAGCTTCTCCCGGACTCCGGGTAAA<br>TGA | |
| SM1B244 | pDR000030<br>218 | ATGGCTTGGGTGTGGACCTTGCTATTCCTGA<br>TGGCAGCTGCCCAAAGTATACAGGCCGAGG<br>TCCAGCTGCAGGAATCTGGCCCTAGCCTGGT<br>CAAGCCCAGCCAGACCCTGAGCCTGACCTGT<br>AGCGTGACCGGCGACAGCATCACCAGCGAC<br>TACTGGAACTGGATCCGGAAGTTCCCCGGCA<br>ACAAGCTCGAGTACATGGGCTACATCAGCT<br>ACAGCGGCAGCACCTACTACAACCCCAGCC<br>TGAAGTCCCGGATCTCCATCACCCGGGACAC<br>CAGCAAGAACCAGTACTATCTGCAGCTGAA<br>CAGCGTGACCACCGAGGACACCGCCACCTA<br>CTATTGTGCCGGCGACTACGGCAGCCCCTAC<br>GCCATGGATTATTGGGGCAGGGCACCTCCG<br>TGACCGTGTCTAGTGCCAAAACAACAGCAC<br>CAAGTGTCTATCCACTGGCCCCTGTGTGTGG<br>AGATACAACTGGCTCCTCGGTGACTCTAGGA<br>TGCCTGGTCAAGGGTTATTTCCCTGAGCCAG<br>TGACCTTGACCTGGAACTCTGGATCCCTGTC<br>CAGTGGTGTGCACACCTTCCCAGCTGTCCTG<br>CAGTCTGACCTCTACACCCTCAGCAGCTCAG<br>TGACTGTAACCTCGAGCACCTGGCCCAGCCA<br>GTCCATCACCTGCAATGTGGCCCACCCGGCA<br>AGCAGCACCAAGGTGGACAAGAAAATTGAG<br>CCCAGAGGGCCCACAATCAAGCCCTGTCCTC<br>CATGCAAATGCCCAGCACCTAACCTCTTGGG<br>TGGACCATCCGTCTTCATCTTCCCTCCAAAG<br>ATCAAGGATGTACTCATGATCTCCCTGAGCC<br>CCATAGTCACATGTGTGGTGGTGGATGTGAG<br>CGAGGATGACCCAGATGTCCAGATCAGCTG<br>GTTTGTGAACAACGTGGAAGTACACACAGC | 884 |

TABLE 27-continued

LukAB Antibody Heavy Chain Primary Transcripts

| mAB/<br>Fab name | Con-<br>struct ID | Heavy Chain Primary Transcript | SEQ ID NO: |
|---|---|---|---|
| | | TCAGACACAAACCCATAGAGAGGATTACAA<br>CAGTACTCTCCGGGTGGTCAGTGCCCTCCCC<br>ATCCAGCACCAGGACTGGATGAGTGGCAAG<br>GAGTTCAAATGCAAGGTCAACAACAAAGAC<br>CTCCCAGCGCCCATCGAGAGAACCATCTCAA<br>AACCCAAAGGGTCAGTAAGAGCTCCACAGG<br>TATATGTCTTGCCTCCACCAGAAGAAGAGAT<br>GACTAAGAAACAGGTCACTCTGACCTGCAT<br>GGTCACAGACTTCATGCCTGAAGACATTTAC<br>GTGGAGTGGACCAACAACGGGAAAACAGAG<br>CTAAACTACAAGAACACTGAACCAGTCCTG<br>GACTCTGATGGTTCTTACTTCATGTACAGCA<br>AGCTGAGAGTGGAAAAGAAGAACTGGGTGG<br>AAAGAAATAGCTACTCCTGTTCAGTGGTCCA<br>CGAGGGTCTGCACAATCACCACACGACTAA<br>GAGCTTCTCCCGGACTCCGGGTAAATGA | |
| SM1B245 | pDR000030<br>219 | ATGGCTTGGGTGTGGACCTTGCTATTCCTGA<br>TGGCAGCTGCCCAAAGTATACAGGCCCAGG<br>TCCAGCTGCAGCAGTCTGGCGCTGAACTGGC<br>CAAGCCTGGGGCCAGCGTGAAGATGAGCTG<br>CAAGAGCAGCGGCTACACCTTCAGCACCTA<br>CTGGATGCACTGGGTCAAGCAGAGGCCAGG<br>CCAGGGCCTGGAATGGATCGGCTACATCAA<br>CCCCAACACCGGCTACACAGAGTACAACCA<br>GAAGTTCAAGGACACCGCCACCCTGACCGC<br>CGACAAGTCTAGCAGCACCGCCTACATGCA<br>GCTGAGCAGCCTGACCAGCGAGGACAGCGC<br>CGTGTACTATTGTGCCAGAGGCGGCAGCAA<br>GGCCTTCCCCTACTACGCCATGGACTATTGG<br>GGCCAGGGCACCAGCGTGACCGTGTCTAGT<br>GCCAAAACAACAGCACCAAGTGTCTATCCA<br>CTGGCCCCTGTGTGTGGAGATACAACTGGCT<br>CCTCGGTGACTCTAGGATGCCTGGTCAAGGG<br>TTATTTCCCTGAGCCAGTGACCTTGACCTGG<br>AACTCTGGATCCCTGTCCAGTGGTGTGCACA<br>CCTTCCCAGCTGTCCTGCAGTCTGACCTCTA<br>CACCCTCAGCAGCTCAGTGACTGTAACCTCG<br>AGCACCTGGCCCAGCCAGTCCATCACCTGCA<br>ATGTGGCCCACCCGGCAAGCAGCACCAAGG<br>TGGACAAGAAAATTGAGCCCAGAGGGCCCA<br>CAATCAAGCCCTGTCCTCCATGCAAATGCCC<br>AGCACCTAACCTCTTGGGTGGACCATCCGTC<br>TTCATCTTCCCTCCAAAGATCAAGGATGTAC<br>TCATGATCTCCCTGAGCCCCATAGTCACATG<br>TGTGGTGGTGGATGTGAGCGAGGATGACCC<br>AGATGTCCAGATCAGCTGGTTTGTGAACAAC<br>GTGGAAGTACACACAGCTCAGACACAAACC<br>CATAGAGAGGATTACAACAGTACTCTCCGG<br>GTGGTCAGTGCCCTCCCCATCCAGCACCAGG<br>ACTGGATGAGTGGCAAGGAGTTCAAATGCA<br>AGGTCAACAACAAAGACCTCCCAGCGCCCA<br>TCGAGAGAACCATCTCAAAACCCAAAGGGT<br>CAGTAAGAGCTCCACAGGTATATGTCTTGCC<br>TCCACCAGAAGAAGAGATGACTAAGAAACA<br>GGTCACTCTGACCTGCATGGTCACAGACTTC<br>ATGCCTGAAGACATTTACGTGGAGTGGACC<br>AACAACGGGAAAACAGAGCTAAACTACAAG<br>AACACTGAACCAGTCCTGGACTCTGATGGTT<br>CTTACTTCATGTACAGCAAGCTGAGAGTGGA<br>AAAGAAGAACTGGGTGGAAAGAAATAGCTA<br>CTCCTGTTCAGTGGTCCACGAGGGTCTGCAC<br>AATCACCACACGACTAAGAGCTTCTCCCGGA<br>CTCCGGGTAAATGA | 885 |
| SM1B246 | pDR000030<br>220 | ATGGCTTGGGTGTGGACCTTGCTATTCCTGA<br>TGGCAGCTGCCCAAAGTATACAGGCCCGAGA<br>TCCAGCTGCAGCAGTCTGGCCCTGAGCTGGT<br>CAAGCCTGGGGCCAGCGTGAAGATGAGCTG<br>CAAGGCCAGCGGCTACAGCTTCACCGGCTA<br>CAACATGCACTGGGTCAAGCAGAGCCACGG<br>CAAGAGCCTGGAATGGATCGGCTACATCGA<br>CCCCTACAACGGGGCCACCAGCCACAACCA | 886 |

TABLE 27-continued

LukAB Antibody Heavy Chain Primary Transcripts

| mAB/<br>Fab name | Con-<br>struct ID | Heavy Chain Primary Transcript | SEQ ID NO: |
|---|---|---|---|
| | | GAAGTTCAAGGGCAAGGCCACCCTGACCGT<br>GGAAAAGAGCAGCAGCACCGCCTACATGCA<br>GCTGAACAGCCTGACCAGCGAGGACAGCGC<br>CGTGTACTACTGCGCCAGAGGCCTGTACGGC<br>GACTATTGGTACGCCTATTGGGGCCAGGGCA<br>CCCTGGTCACCGTGTCTAGTGCCAAAACAAC<br>AGCACCAAGTGTCTATCCACTGGCCCCTGTG<br>TGTGGAGATACAACTGGCTCCTCGGTGACTC<br>TAGGATGCCTGGTCAAGGGTTATTTCCCTGA<br>GCCAGTGACCTTGACCTGGAACTCTGGATCC<br>CTGTCCAGTGGTGTGCACACCTTCCCAGCTG<br>TCCTGCAGTCTGACCTCTACACCCTCAGCAG<br>CTCAGTGACTGTAACCTCGAGCACCTGGCCC<br>AGCCAGTCCATCACCTGCAATGTGGCCCACC<br>CGGCAAGCAGCACCAAGGTGGACAAGAAAA<br>TTGAGCCCAGAGGGCCCACAATCAAGCCCT<br>GTCCTCCATGCAAATGCCCAGCACCTAACCT<br>CTTGGGTGGACCATCCGTCTTCATCTTCCCTC<br>CAAAGATCAAGGATGTACTCATGATCTCCCT<br>GAGCCCCATAGTCACATGTGTGGTGGTGGAT<br>GTGAGCGAGGATGACCCAGATGTCCAGATC<br>AGCTGGTTTGTGAACAACGTGGAAGTACAC<br>ACAGCTCAGACACAAACCCATAGAGAGGAT<br>TACAACAGTACTCTCCGGGTGGTCAGTGCCC<br>TCCCCATCCAGCACCAGGACTGGATGAGTG<br>GCAAGGAGTTCAAATGCAAGGTCAACAACA<br>AAGACCTCCCAGCGCCCATCGAGAGAACCA<br>TCTCAAAACCCAAAGGGTCAGTAAGAGCTC<br>CACAGGTATATGTCTTGCCTCCACCAGAAGA<br>AGAGATGACTAAGAAACAGGTCACTCTGAC<br>CTGCATGGTCACAGACTTCATGCCTGAAGAC<br>ATTTACGTGGAGTGGACCAACAACGGGAAA<br>ACAGAGCTAAACTACAAGAACACTGAACCA<br>GTCCTGGACTCTGATGGTTCTTACTTCATGT<br>ACAGCAAGCTGAGAGTGGAAAAGAAGAACT<br>GGGTGGAAAGAAATAGCTACTCCTGTTCAGT<br>GGTCCACGAGGGTCTGCACAATCACCACAC<br>GACTAAGAGCTTCTCCCGGACTCCGGGTAAA<br>TGA | |
| SM1B247 | pDR000030<br>221 | ATGGCTTGGGTGTGGACCTTGCTATTCCTGA<br>TGGCAGCTGCCCAAAGTATACAGGCCGAGG<br>TGCAGCTGGTGGAATCTGGCGGAGGACTGG<br>TCAAGCCTGGCGGCAGCCTGAAACTGTCTTG<br>CGCCGCCAGCGGCTTCACCTTCAGCGACTAC<br>TACATGTACTGGGTCCGACAGACCCCTGAGA<br>AGCGGCTGGAATGGGTGGCCACAATCAGCG<br>ACGGCGGCAGCTACACCTTCTACCCCGACAG<br>CGTGAAGGGCCGGTTCACCATCAGCCGGGA<br>CAACGCCAAGAACAACCTGTACCTGCAGAT<br>GTCCAGCCTGAAGTCCGAGGACACCGCCAT<br>GTACTACTGCGCCAGAGGCCCCACCTACTAC<br>GGCCTGGATTATTGGGGCCAGGGCACCACC<br>CTGACCGTGTCTAGTGCCAAAACAACAGCA<br>CCAAGTGTCTATCCACTGGCCCCTGTGTGTG<br>GAGATACAACTGGCTCCTCGGTGACTCTAGG<br>ATGCCTGGTCAAGGGTTATTTCCCTGAGCCA<br>GTGACCTTGACCTGGAACTCTGGATCCCTGT<br>CCAGTGGTGTGCACACCTTCCCAGCTGTCCT<br>GCAGTCTGACCTCTACACCCTCAGCAGCTCA<br>GTGACTGTAACCTCGAGCACCTGGCCCAGCC<br>AGTCCATCACCTGCAATGTGGCCCACCCGGC<br>AAGCAGCACCAAGGTGGACAAGAAAATTGA<br>GCCCAGAGGGCCCACAATCAAGCCCTGTCCT<br>CCATGCAAATGCCCAGCACCTAACCTCTTGG<br>GTGGACCATCCGTCTTCATCTTCCCTCCAAA<br>GATCAAGGATGTACTCATGATCTCCCTGAGC<br>CCCATAGTCACATGTGTGGTGGTGGATGTGA<br>GCGAGGATGACCCAGATGTCCAGATCAGCT<br>GGTTTGTGAACAACGTGGAAGTACACACAG<br>CTCAGACACAAACCCATAGAGAGGATTACA<br>ACAGTACTCTCCGGGTGGTCAGTGCCCTCCC<br>CATCCAGCACCAGGACTGGATGAGTGGCAA<br>GGAGTTCAAATGCAAGGTCAACAACAAAGA | 887 |

TABLE 27-continued

LukAB Antibody Heavy Chain Primary Transcripts

| mAB/Fab name | Construct ID | Heavy Chain Primary Transcript | SEQ ID NO: |
|---|---|---|---|
| | | CCTCCCAGCGCCCATCGAGAGAACCATCTCA<br>AAACCCAAAGGGTCAGTAAGAGCTCCACAG<br>GTATATGTCTTGCCTCCACCAGAAGAAGAGA<br>TGACTAAGAAACAGGTCACTCTGACCTGCAT<br>GGTCACAGACTTCATGCCTGAAGACATTTAC<br>GTGGAGTGGACCAACAACGGGAAAACAGAG<br>CTAAACTACAAGAACACTGAACCAGTCCTG<br>GACTCTGATGGTTCTTACTTCATGTACAGCA<br>AGCTGAGAGTGGAAAAGAAGAACTGGGTGG<br>AAAGAAATAGCTACTCCTGTTCAGTGGTCCA<br>CGAGGGTCTGCACAATCACCACACGACTAA<br>GAGCTTCTCCCGGACTCCGGGTAAATGA | |
| SM1B248 | pDR000030<br>222 | ATGGCTTGGGTGTGGACCTTGCTATTCCTGA<br>TGGCAGCTGCCCAAAGTATACAGGCCCAGG<br>TCCAGCTGCAGCAGCCTGGCGCTGAACTCGT<br>CAGACCTGGCGCTTCTGTGCGGCTGAGCTGC<br>AAGGCCAGCGGCTACAGCTTCACCAGCTACT<br>GGATGAGCTGGGTCAAAGTGCGGCCAGGCC<br>AGGGCCTGGAATGGATCGGAATGATCCACC<br>CCAGCGACAGCGAGACACGGCTGAACCAGA<br>AGTTCAAGGACAAGGCCACCCTGACCGTGG<br>ACAAGAGCAGCAGCACCGCCTACATGCAGC<br>TGTCCAGCCCCACAAGCGAGGACAGCGCCG<br>TGTACTACTGCGCCAGACTGTACGTGGACTT<br>CTTCGACTACTGGGGCCAGGGCACCACACTG<br>ACAGTGTCCTCTGCCAAAACAACAGCACCA<br>AGTGTCTATCCACTGGCCCCTGTGTGTGGAG<br>ATACAACTGGCTCCTCGGTGACTCTAGGATG<br>CCTGGTCAAGGGTTATTTCCCTGAGCCAGTG<br>ACCTTGACCTGGAACTCTGGATCCCTGTCCA<br>GTGGTGTGCACACCTTCCCAGCTGTCCTGCA<br>GTCTGACCTCTACACCCTCAGCAGCTCAGTG<br>ACTGTAACCTCGAGCACCTGGCCCAGCCAGT<br>CCATCACCTGCAATGTGGCCCACCCGGCAAG<br>CAGCACCAAGGTGGACAAGAAAATTGAGCC<br>CAGAGGGCCCACAATCAAGCCCTGTCCTCCA<br>TGCAAATGCCCAGCACCTAACCTCTTGGGTG<br>GACCATCCGTCTTCATCTTCCCTCCAAAGAT<br>CAAGGATGTACTCATGATCTCCCTGAGCCCC<br>ATAGTCACATGTGTGGTGGTGGATGTGAGCG<br>AGGATGACCCAGATGTCCAGATCAGCTGGTT<br>TGTGAACAACGTGGAAGTACACACAGCTCA<br>GACACAAACCCATAGAGAGGATTACAACAG<br>TACTCTCCGGGTGGTCAGTGCCCTCCCCATC<br>CAGCACCAGGACTGGATGAGTGGCAAGGAG<br>TTCAAATGCAAGGTCAACAACAAAGACCTC<br>CAGCGCCCATCGAGAGAACCATCTCAAAA<br>CCCAAAGGGTCAGTAAGAGCTCCACAGGTA<br>TATGTCTTGCCTCCACCAGAAGAAGAGATGA<br>CTAAGAAACAGGTCACTCTGACCTGCATGGT<br>CACAGACTTCATGCCTGAAGACATTTACGTG<br>GAGTGGACCAACAACGGGAAAACAGAGCTA<br>AACTACAAGAACACTGAACCAGTCCTGGAC<br>TCTGATGGTTCTTACTTCATGTACAGCAAGC<br>TGAGAGTGGAAAAGAAGAACTGGGTGGAAA<br>GAAATAGCTACTCCTGTTCAGTGGTCCACGA<br>GGGTCTGCACAATCACCACACGACTAAGAG<br>CTTCTCCCGGACTCCGGGTAAATGA | 888 |
| SM1B249 | pDR000030<br>223 | ATGGCTTGGGTGTGGACCTTGCTATTCCTGA<br>TGGCAGCTGCCCAAAGTATACAGGCCGACG<br>TGAAGCTGGTGGAATCTGGCGGCGGACTGG<br>TCAAGCTGGGCGGCAGCCTGAAACTGTCTTG<br>CGCCGCCAGCGGCTTCACCTTCAGCAGCTAC<br>TACATGAGCTGGGTCCGACAGACCCCTGAG<br>AAGCGGCTGGAACTGGTGGCCGCCATCAAC<br>AGCAATGGCGGCAGCACCTACTACCCCGAC<br>ACCGTGAAGGGCCGGTTCACCATCTCCCGGG<br>ACAACGCCAAGAACACCCTGTACCTGCAGA<br>TGTCCAGCCTGAAGTCCGAGGACACCGCCCT<br>GTACTACTGCGCCAGACCCGACTACCCCTAC<br>GCCATGGGATTACTGGGGCCAGGGCACCAGC | 889 |

TABLE 27-continued

LukAB Antibody Heavy Chain Primary Transcripts

| mAB/Fab name | Construct ID | Heavy Chain Primary Transcript | SEQ ID NO: |
|---|---|---|---|
| | | GTGACCGTGTCATCTGCCAAAACAACAGCA<br>CCAAGTGTCTATCCACTGGCCCCTGTGTGTG<br>GAGATACAACTGGCTCCTCGGTGACTCTAGG<br>ATGCCTGGTCAAGGGTTATTTCCCTGAGCCA<br>GTGACCTTGACCTGGAACTCTGGATCCCTGT<br>CCAGTGGTGTGCACACCTTCCCAGCTGTCCT<br>GCAGTCTGACCTCTACACCCTCAGCAGCTCA<br>GTGACTGTAACCTCGAGCACCTGGCCCAGCC<br>AGTCCATCACCTGCAATGTGGCCCACCCGGC<br>AAGCAGCACCAAGGTGGACAAGAAAATTGA<br>GCCCAGAGGGCCCACAATCAAGCCCTGTCCT<br>CCATGCAAATGCCCAGCACCTAACCTCTTGG<br>GTGGACCATCCGTCTTCATCTTCCCTCCAAA<br>GATCAAGGATGTACTCATGATCTCCCTGAGC<br>CCCATAGTCACATGTGTGGTGGTGGATGTGA<br>GCGAGGATGACCCAGATGTCCAGATCAGCT<br>GGTTTGTGAACAACGTGGAAGTACACACAG<br>CTCAGACACAAACCCATAGAGAGGATTACA<br>ACAGTACTCTCCGGGTGGTCAGTGCCCTCCC<br>CATCCAGCACCAGGACTGGATGAGTGGCAA<br>GGAGTTCAAATGCAAGGTCAACAACAAAGA<br>CCTCCCAGCGCCCATCGAGAGAACCATCTCA<br>AAACCCAAAGGGTCAGTAAGAGCTCCACAG<br>GTATATGTCTTGCCTCCACCAGAAGAAGAGA<br>TGACTAAGAAACAGGTCACTCTGACCTGCAT<br>GGTCACAGACTTCATGCCTGAAGACATTTAC<br>GTGGAGTGGACCAACAACGGGAAAACAGAG<br>CTAAACTACAAGAACACTGAACCAGTCCTG<br>GACTCTGATGGTTCTTACTTCATGTACAGCA<br>AGCTGAGAGTGGAAAAGAAGAACTGGGTGG<br>AAAGAAATAGCTACTCCTGTTCAGTGGTCCA<br>CGAGGGTCTGCACAATCACCACACGACTAA<br>GAGCTTCTCCCGGACTCCGGGTAAATGA | |
| SM1B250 | pDR000030224 | ATGGCTTGGGTGTGGACCTTGCTATTCCTGA<br>TGGCAGCTGCCCAAAGTATACAGGCCCAGA<br>TCCAGCTGGTGCAGAGCGGCCCTGAGCTGA<br>AGAAACCCGGCGAGACAGTGAAGATCAGCT<br>GCAAGGCCAGCGGCTACACCTTCACCAACT<br>ACGGCATGAACTGGGTCAAGCAGGCCCCTG<br>GCAAGGGCCTGAAGTGGATGGGCTGGATCA<br>ACACCTACACCGGCGAGCCCACCTACGCCG<br>ACGACTTCAAGGGCAGATTCGCCTTCAGCCT<br>GGAAACCAGCGCCAGCACCGCCTACCTGCA<br>GATCAACAACCTGAAGAACGAGGACACCGC<br>CACCTACTTTTGCGCCAGAAGCCCCAGCTAC<br>GGCAGCAGAGGCGCTTGGTTTGCCTATTGGA<br>GCCAGGGCACCCTGGTCACCGTGTCTGCTGC<br>CAAAACAACAGCACCAAGTGTCTATCCACT<br>GGCCCCTGTGTGTGGAGATACAACTGGCTCC<br>TCGGTGACTCTAGGATGCCTGGTCAAGGGTT<br>ATTTCCCTGAGCCAGTGACCTTGACCTGGAA<br>CTCTGGATCCCTGTCCAGTGGTGTGCACACC<br>TTCCCAGCTGTCCTGCAGTCTGACCTCTACA<br>CCCTCAGCAGCTCAGTGACTGTAACCTCGAG<br>CACCTGGCCCAGCCAGTCCATCACCTGCAAT<br>GTGGCCCACCCGGCAAGCAGCACCAAGGTG<br>GACAAGAAAATTGAGCCCAGAGGGCCCACA<br>ATCAAGCCCTGTCCTCCATGCAAATGCCCAG<br>CACCTAACCTCTTGGGTGGACCATCCGTCTT<br>CATCTTCCCTCCAAAGATCAAGGATGTACTC<br>ATGATCTCCCTGAGCCCCATAGTCACATGTG<br>TGGTGGTGGATGTGAGCGAGGATGACCCAG<br>ATGTCCAGATCAGCTGGTTTGTGAACAACGT<br>GGAAGTACACACAGCTCAGACACAAACCCA<br>TAGAGAGGATTACAACAGTACTCTCCGGGT<br>GGTCAGTGCCCTCCCCATCCAGCACCAGGAC<br>TGGATGAGTGGCAAGGAGTTCAAATGCAAG<br>GTCAACAACAAAGACCTCCCAGCGCCCATC<br>GAGAGAACCATCTCAAAACCCAAAGGGTCA<br>GTAAGAGCTCCACAGGTATATGTCTTGCCTC<br>CACCAGAAGAAGAGATGACTAAGAAACAGG<br>TCACTCTGACCTGCATGGTCACAGACTTCAT<br>GCCTGAAGACATTTACGTGGAGTGGACCAA | 890 |

TABLE 27-continued

LukAB Antibody Heavy Chain Primary Transcripts

| mAB/ Fab name | Construct ID | Heavy Chain Primary Transcript | SEQ ID NO: |
|---|---|---|---|
| | | CAACGGGAAAACAGAGCTAAACTACAAGAA CACTGAACCAGTCCTGGACTCTGATGGTTCT TACTTCATGTACAGCAAGCTGAGAGTGGAA AAGAAGAACTGGGTGGAAAGAAATAGCTAC TCCTGTTCAGTGGTCCACGAGGGTCTGCACA ATCACCACACGACTAAGAGCTTCTCCCGGAC TCCGGGTAAATGA | |
| SM1B251 | pDR000030 225 | ATGGCTTGGGTGTGGACCTTGCTATTCCTGA TGGCAGCTGCCCAAAGTATACAGGCCCAGA TCCAGCTGGTGCAGAGCGGCCCTGAGCTGA AGAAACCCGGCGAGACAGTGAAGATCAGCT GCAAGGCCAGCGGCTACACCTTCACCAACT ACGGCATGAACTGGGTCAAGCAGGCCCCTG GCAAGGGCCTGAAGTGGATGGGCTGGATCA ACACCTACACCGGCGAGCCCACCTACGCCG ACGACTTCAAGGGCAGATTCGCCTTCAGCCT GGAAACCAGCGCCAGCACCGCCTACCTGCA GATCAACAACCTGAAGAACGAGGACACCGC CACCTACTTTTGCGCCAGAAGCCCCAGCTAC GGCAGCAGAGGCGCTTGGTTTGCCTACTGGG GCCAGGGCACCCTGGTCACAGTGTCTGCTGC CAAAACAACAGCACCAAGTGTCTATCCACT GGCCCCTGTGTGTGGAGATACAACTGGCTCC TCGGTGACTCTAGGATGCCTGGTCAAGGGTT ATTTCCCTGAGCCAGTGACCTTGACCTGGAA CTCTGGATCCCTGTCCAGTGGTGTGCACACC TTCCCAGCTGTCCTGCAGTCTGACCTCTACA CCCTCAGCAGCTCAGTGACTGTAACCTCGAG CACCTGGCCCAGCCAGTCCATCACCTGCAAT GTGGCCCACCCGGCAAGCAGCACCAAGGTG GACAAGAAAATTGAGCCCAGAGGGCCCACA ATCAAGCCCTGTCCTCCATGCAAATGCCCAG CACCTAACCTCTTGGGTGACCATCCGTCTT CATCTTCCCTCCAAAGATCAAGGATGTACTC ATGATCTCCCTGAGCCCCATAGTCACATGTG TGGTGGTGGATGTGAGCGAGGATGACCCAG ATGTCCAGATCAGCTGGTTTGTGAACAACGT GGAAGTACACACAGCTCAGACACAAACCCA TAGAGAGGATTACAACAGTACTCTCCGGGT GGTCAGTGCCCTCCCCATCCAGCACCAGGAC TGGATGAGTGGCAAGGAGTTCAAATGCAAG GTCAACAACAAAGACCTCCCAGCGCCCATC GAGAGAACCATCTCAAAACCCAAAGGGTCA GTAAGAGCTCCACAGGTATATGTCTTGCCTC CACCAGAAGAAGAGATGACTAAGAAACAGG TCACTCTGACCTGCATGGTCACAGACTTCAT GCCTGAAGACATTTACGTGGAGTGGACCAA CAACGGGAAAACAGAGCTAAACTACAAGAA CACTGAACCAGTCCTGGACTCTGATGGTTCT TACTTCATGTACAGCAAGCTGAGAGTGGAA AAGAAGAACTGGGTGGAAAGAAATAGCTAC TCCTGTTCAGTGGTCCACGAGGGTCTGCACA ATCACCACACGACTAAGAGCTTCTCCCGGAC TCCGGGTAAATGA | 891 |
| SM1B252 | pDR000030 226 | ATGGCTTGGGTGTGGACCTTGCTATTCCTGA TGGCAGCTGCCCAAAGTATACAGGCCCAGG TCCAGCTGCAGCAGAGCGGAGCCGAACTGA TGAAGCCTGGGGCCAGCGTGAAGATCAGCT GCAAGGCCAGCGGCTACACCTTCAGCGACT ACTGGATCGAGTGGATCAAGCAGCGGCCTG GCCACGGCCTGGAATGGATGGGAGAGATCC TGCCCGGCAGCGACAAGACCAACTACAACG AGAAGTTCAAGGGCAAGGCCACCTTCACCG CCGACAGCAGCAGCAACACCGCCTACATGC AGCTGAACAGCCTGACCAGCGAGGACAGCG CCGTGTTCTATTGTGCCACAGCCGGCGACGA CTACGTGAAGTGGGGACAGGGCACCCTGGT CACCGTGTCTGCTGCCAAAACAACAGCACC AAGTGTCTATCCACTGGCCCCTGTGTGTGGA GATACAACTGGCTCCTCGGTGACTCTAGGAT GCCTGGTCAAGGGTTATTTCCCTGAGCCAGT | 892 |

TABLE 27-continued

LukAB Antibody Heavy Chain Primary Transcripts

| mAB/Fab name | Construct ID | Heavy Chain Primary Transcript | SEQ ID NO: |
|---|---|---|---|
| | | GACCTTGACCTGGAACTCTGGATCCCTGTCC<br>AGTGGTGTGCACACCTTCCCAGCTGTCCTGC<br>AGTCTGACCTCTACACCCTCAGCAGCTCAGT<br>GACTGTAACCTCGAGCACCTGGCCCAGCCA<br>GTCCATCACCTGCAATGTGGCCCACCCGGCA<br>AGCAGCACCAAGGTGGACAAGAAAATTGAG<br>CCCAGAGGGCCCACAATCAAGCCCTGTCCTC<br>CATGCAAATGCCCAGCACCTAACCTCTTGGG<br>TGGACCATCCGTCTTCATCTTCCCTCCAAAG<br>ATCAAGGATGTACTCATGATCTCCCTGAGCC<br>CCATAGTCACATGTGTGGTGGTGGATGTGAG<br>CGAGGATGACCCAGATGTCCAGATCAGCTG<br>GTTTGTGAACAACGTGGAAGTACACACAGC<br>TCAGACACAAACCCATAGAGAGGATTACAA<br>CAGTACTCTCCGGGTGGTCAGTGCCCTCCCC<br>ATCCAGCACCAGGACTGGATGAGTGGCAAG<br>GAGTTCAAATGCAAGGTCAACAACAAAGAC<br>CTCCCAGCGCCCATCGAGAGAACCATCTCAA<br>AACCCAAAGGGTCAGTAAGAGCTCCACAGG<br>TATATGTCTTGCCTCCACCAGAAGAAGAGAT<br>GACTAAGAAACAGGTCACTCTGACCTGCAT<br>GGTCACAGACTTCATGCCTGAAGACATTTAC<br>GTGGAGTGGACCAACAACGGGAAAACAGAG<br>CTAAACTACAAGAACACTGAACCAGTCCTG<br>GACTCTGATGGTTCTTACTTCATGTACAGCA<br>AGCTGAGAGTGGAAAAGAAGAACTGGGTGG<br>AAAGAAATAGCTACTCCTGTTCAGTGGTCCA<br>CGAGGGTCTGCACAATCACCACACGACTAA<br>GAGCTTCTCCCGGACTCCGGGTAAATGA | |
| SM1B253 | pDR000030227 | ATGGCTTGGGTGTGGACCTTGCTATTCCTGA<br>TGGCAGCTGCCCAAAGTATACAGGCCGAAG<br>TCCAGCTGCAGCAGAGCGGAGCCGAACTGG<br>TCAAGCCTGGCGCTTCCGTGAAGCTGAGCTG<br>CACCGCCAGCGGCTTCAACATCAAGGACAC<br>CTACATGCACTGGGTCCGACAGAGGCCCGA<br>GCAGGGCCTGGAATGGATCGGCAGAATCGA<br>CCCCGCCAACGACATCACCAAATACGACCC<br>CAAGTTCCAGGGCAAGGCCACCATCACCGC<br>CGACACCAGCAGCAACACAGCCTACCTGCA<br>GCTGAGCAGCCTGACCAGCGAGGACACCGC<br>CGTGTACTACTGCGGCAGAGACTGGGCCGA<br>TTACTGGGGCCAGGGCACCACCCTGACAGT<br>GTCTAGTGCCAAAACAACAGCACCAAGTGT<br>CTATCCACTGGCCCCTGTGTGTGGAGATACA<br>ACTGGCTCCTCGGTGACTCTAGGATGCCTGG<br>TCAAGGGTTATTTCCCTGAGCCAGTGACCTT<br>GACCTGGAACTCTGGATCCCTGTCCAGTGGT<br>GTGCACACCTTCCCAGCTGTCCTGCAGTCTG<br>ACCTCTACACCCTCAGCAGCTCAGTGACTGT<br>AACCTCGAGCACCTGGCCCAGCCAGTCCATC<br>ACCTGCAATGTGGCCCACCCGGCAAGCAGC<br>ACCAAGGTGGACAAGAAAATTGAGCCCAGA<br>GGGCCCACAATCAAGCCCTGTCCTCCATGCA<br>AATGCCCAGCACCTAACCTCTTGGGTGGACC<br>ATCCGTCTTCATCTTCCCTCCAAAGATCAAG<br>GATGTACTCATGATCTCCCTGAGCCCCATAG<br>TCACATGTGTGGTGGTGGATGTGAGCGAGG<br>ATGACCCAGATGTCCAGATCAGCTGGTTTGT<br>GAACAACGTGGAAGTACACACAGCTCAGAC<br>ACAAACCCATAGAGAGGATTACAACAGTAC<br>TCTCCGGGTGGTCAGTGCCCTCCCCATCCAG<br>CACCAGGACTGGATGAGTGGCAAGGAGTTC<br>AAATGCAAGGTCAACAACAAAGACCTCCCA<br>GCGCCCATCGAGAGAACCATCTCAAAACCC<br>AAAGGGTCAGTAAGAGCTCCACAGGTATAT<br>GTCTTGCCTCCACCAGAAGAAGAGATGACT<br>AAGAAACAGGTCACTCTGACCTGCATGGTC<br>ACAGACTTCATGCCTGAAGACATTTACGTGG<br>AGTGGACCAACAACGGGAAAACAGAGCTAA<br>ACTACAAGAACACTGAACCAGTCCTGGACT<br>CTGATGGTTCTTACTTCATGTACAGCAAGCT<br>GAGAGTGGAAAAGAAGAACTGGGTGGAAA<br>GAAATAGCTACTCCTGTTCAGTGGTCCACGA | 893 |

TABLE 27-continued

LukAB Antibody Heavy Chain Primary Transcripts

| mAB/<br>Fab name | Con-<br>struct ID | Heavy Chain Primary Transcript | SEQ ID NO: |
|---|---|---|---|
| | | GGGTCTGCACAATCACCACACGACTAAGAG<br>CTTCTCCCGGACTCCGGGTAAATGA | |
| SM1B254 | pDR000030<br>228 | ATGGCTTGGGTGTGGACCTTGCTATTCCTGA<br>TGGCAGCTGCCCAAAGTATACAGGCCGAAG<br>TCCAGCTGCAGCAGAGCGGAGCCGAACTGG<br>TCAAGCCTGGCGCTTCCGTGAAGCTGAGCTG<br>CACCGCCAGCGGCTTCAACATCAAGGACAC<br>CTACATGCACTGGGTCAAGCAGCGGAGCGA<br>GCAGGGCCTGGAATGGATCGGCAGAATCAA<br>CCCCGCCAACGACAACACCAAATACGACCC<br>CAAGTTCCAGGGCAAGGCCACCATCACCGC<br>CGACACCAGCAGCAACACAGCCTACCTGCA<br>GCTGAGCAGCCTGACCAGCGAGGACACCGC<br>CGTGTACTACTGCGGCAGAGACTGGGCCGA<br>TTACTGGGGCCAGGGCACCACCCTGACAGT<br>GTCTAGTGCCAAAACAACAGCACCAAGTGT<br>CTATCCACTGGCCCCTGTGTGTGGAGATACA<br>ACTGGCTCCTCGGTGACTCTAGGATGCCTGG<br>TCAAGGGTTATTTCCCTGAGCCAGTGACCTT<br>GACCTGGAACTCTGGATCCCTGTCCAGTGGT<br>GTGCACACCTTCCCAGCTGTCCTGCAGTCTG<br>ACCTCTACACCCTCAGCAGCTCAGTGACTGT<br>AACCTCGAGCACCTGGCCCAGCCAGTCCATC<br>ACCTGCAATGTGGCCCACCCGGCAAGCAGC<br>ACCAAGGTGGACAAGAAAATTGAGCCCAGA<br>GGGCCCACAATCAAGCCCTGTCCTCCATGCA<br>AATGCCCAGCACCTAACCTCTTGGGTGGACC<br>ATCCGTCTTCATCTTCCCTCCAAAGATCAAG<br>GATGTACTCATGATCTCCCTGAGCCCCATAG<br>TCACATGTGTGGTGGATGTGAGCGAGG<br>ATGACCCAGATGTCCAGATCAGCTGGTTTGT<br>GAACAACGTGGAAGTACACACAGCTCAGAC<br>ACAAACCCATAGAGAGGATTACAACAGTAC<br>TCTCCGGGTGGTCAGTGCCCTCCCCATCCAG<br>CACCAGGACTGGATGAGTGGCAAGGAGTTC<br>AAATGCAAGGTCAACAACAAAGACCTCCCA<br>GCGCCCATCGAGAACCATCTCAAAACCC<br>AAAGGGTCAGTAAGAGCTCCACAGGTATAT<br>GTCTTGCCTCCACCAGAAGAAGAGATGACT<br>AAGAAACAGGTCACTCTGACCTGCATGGTC<br>ACAGACTTCATGCCTGAAGACATTTACGTGG<br>AGTGGACCAACAACGGGAAAACAGAGCTAA<br>ACTACAAGAACACTGAACCAGTCCTGGACT<br>CTGATGGTTCTTACTTCATGTACAGCAAGCT<br>GAGAGTGGAAAAGAAGAACTGGGTGGAAA<br>GAAATAGCTACTCCTGTTCAGTGGTCCACGA<br>GGGTCTGCACAATCACCACACGACTAAGAG<br>CTTCTCCCGGACTCCGGGTAAATGA | 894 |
| SM1B255 | pDR000030<br>229 | ATGGCTTGGGTGTGGACCTTGCTATTCCTGA<br>TGGCAGCTGCCCAAAGTATACAGGCCCAGG<br>TCCAGCTGCAGCAGCCTGGCGCTGAACTGGT<br>CAAGCCAGGCGCTTCCGTGAAGCTGAGCTG<br>CAAGGCCAGCGGCTACACCTTCACCCGGTAC<br>TGGATGCACTGGGTCAAGCAGAGGCCAGGC<br>CAGGGCCTGGAATGGATCGGCGAGATCAAC<br>CCCAACAACGGCCACACCAACTACAACGAG<br>AAGTTCGAGAGCCGGGCCACCCTGACCGTG<br>GACAAGAGCAGCAGCACCGCCTACATGCAG<br>TTCAACAGCCTGACCAGCGAGGACAGCGCC<br>GTGTACTACTGCGGCAGACTGGATGGCCACC<br>TGTACGCCGTGGATTACTGGGGCCAGGGCA<br>CCAGCGTGACCGTGTCATCTGCCAAAACAAC<br>AGCACCAAGTGTCTATCCACTGGCCCCTGTG<br>TGTGGAGATACAACTGGCTCCTCGGTGACTC<br>TAGGATGCCTGGTCAAGGGTTATTTCCCTGA<br>GCCAGTGACCTTGACCTGGAACTCTGGATCC<br>CTGTCCAGTGGTGTGCACACCTTCCCAGCTG<br>TCCTGCAGTCTGACCTCTACACCCTCAGCAG<br>CTCAGTGACTGTAACCTCGAGCACCTGGCCC<br>AGCCAGTCCATCACCTGCAATGTGGCCCACC<br>CGGCAAGCAGCACCAAGGTGGACAAGAAA | 895 |

TABLE 27-continued

LukAB Antibody Heavy Chain Primary Transcripts

| mAB/<br>Fab name | Con-<br>struct ID | Heavy Chain Primary Transcript | SEQ ID NO: |
|---|---|---|---|
| | | TTGAGCCCAGAGGGCCCACAATCAAGCCCT<br>GTCCTCCATGCAAATGCCCAGCACCTAACCT<br>CTTGGGTGGACCATCCGTCTTCATCTTCCCTC<br>CAAAGATCAAGGATGTACTCATGATCTCCCT<br>GAGCCCCATAGTCACATGTGTGGTGGTGGAT<br>GTGAGCGAGGATGACCCAGATGTCCAGATC<br>AGCTGGTTTGTGAACAACGTGGAAGTACAC<br>ACAGCTCAGACACAAACCCATAGAGAGGAT<br>TACAACAGTACTCTCCGGGTGGTCAGTGCCC<br>TCCCCATCCAGCACCAGGACTGGATGAGTG<br>GCAAGGAGTTCAAATGCAAGGTCAACAACA<br>AAGACCTCCCAGCGCCCATCGAGAGAACCA<br>TCTCAAAACCCAAAGGGTCAGTAAGAGCTC<br>CACAGGTATATGTCTTGCCTCCACCAGAAGA<br>AGAGATGACTAAGAAACAGGTCACTCTGAC<br>CTGCATGGTCACAGACTTCATGCCTGAAGAC<br>ATTTACGTGGAGTGGACCAACAACGGGAAA<br>ACAGAGCTAAACTACAAGAACACTGAACCA<br>GTCCTGGACTCTGATGGTTCTTACTTCATGT<br>ACAGCAAGCTGAGAGTGGAAAAGAAGAACT<br>GGGTGGAAAGAAATAGCTACTCCTGTTCAGT<br>GGTCCACGAGGGTCTGCACAATCACCACAC<br>GACTAAGAGCTTCTCCCGGACTCCGGGTAAA<br>TGA | |
| SM1B256 | pDR000030<br>230 | ATGGCTTGGGTGTGGACCTTGCTATTCCTGA<br>TGGCAGCTGCCCAAAGTATACAGGCCCAGG<br>TCCAGCTGCAGCAGCTGGCACAGAGCTGA<br>AGATGCCCGGCACCAGCGTGAAGCTGAGCT<br>GCAAGGCCAGCGGCTACACCTTCACCACCTA<br>CTGGATGCACTGGGTCAAGCTGCGGCCAGG<br>CCAGGGCTTTGAGTGGATCGGCGAGATCAA<br>CCCCAGCAACGACGGCACCAACTACAACGA<br>GAAGTTCAAGCGGAAGGCCACCCTGACCGT<br>GGACAAGCCTAGCAGCACCGCCTACATGCA<br>GCTGTCCAGCCTGACCAGCGAGGACAGCAC<br>CATCTACTACTGCACCATCAGCTACTACGGC<br>TACGGCGACTTCGACTACTGGGGCCAGGGC<br>ACCACACTGACAGTGTCCTCTGCCAAAACAA<br>CAGCACCAAGTGTCTATCCACTGGCCCCTGT<br>GTGTGGAGATACAACTGGCTCCTCGGTGACT<br>CTAGGATGCCTGGTCAAGGGTTATTTCCCTG<br>AGCCAGTGACCTTGACCTGGAACTCTGGATC<br>CCTGTCCAGTGGTGTGCACACCTTCCCAGCT<br>GTCCTGCAGTCTGACCTCTACACCCTCAGCA<br>GCTCAGTGACTGTAACCTCGAGCACCTGGCC<br>CAGCCAGTCCATCACCTGCAATGTGGCCCAC<br>CCGGCAAGCAGCACCAAGGTGGACAAGAAA<br>ATTGAGCCCAGAGGGCCCACAATCAAGCCC<br>TGTCCTCCATGCAAATGCCCAGCACCTAACC<br>TCTTGGGTGGACCATCCGTCTTCATCTTCCCT<br>CCAAAGATCAAGGATGTACTCATGATCTCCC<br>TGAGCCCCATAGTCACATGTGTGGTGGTGGA<br>TGTGAGCGAGGATGACCCAGATGTCCAGAT<br>CAGCTGGTTTGTGAACAACGTGGAAGTACA<br>CACAGCTCAGACACAAACCCATAGAGAGGA<br>TTACAACAGTACTCTCCGGGTGGTCAGTGCC<br>CTCCCCATCCAGCACCAGGACTGGATGAGTG<br>GCAAGGAGTTCAAATGCAAGGTCAACAACA<br>AAGACCTCCCAGCGCCCATCGAGAGAACCA<br>TCTCAAAACCCAAAGGGTCAGTAAGAGCTC<br>CACAGGTATATGTCTTGCCTCCACCAGAAGA<br>AGAGATGACTAAGAAACAGGTCACTCTGAC<br>CTGCATGGTCACAGACTTCATGCCTGAAGAC<br>ATTTACGTGGAGTGGACCAACAACGGGAAA<br>ACAGAGCTAAACTACAAGAACACTGAACCA<br>GTCCTGGACTCTGATGGTTCTTACTTCATGT<br>ACAGCAAGCTGAGAGTGGAAAAGAAGAACT<br>GGGTGGAAAGAAATAGCTACTCCTGTTCAGT<br>GGTCCACGAGGGTCTGCACAATCACCACAC<br>GACTAAGAGCTTCTCCCGGACTCCGGGTAAA<br>TGA | 896 |

TABLE 27-continued

LukAB Antibody Heavy Chain Primary Transcripts

| mAB/ Fab name | Construct ID | Heavy Chain Primary Transcript | SEQ ID NO: |
|---|---|---|---|
| SM1B257 | pDR000030231 | ATGGCTTGGGTGTGGACCTTGCTATTCCTGA TGGCAGCTGCCCAAAGTATACAGGCCCAGG TGCAGCTGAAAGAGTCCGGCCCTGATCTGGT GCAGCCCAGCCAGACCCTGAGCCTGACCTGT ACCGTGTCCGGCTTCAGCCTGACCAGCTACG GCGTGCACTGGGTCCGACAGCCACCTGGCA AAGGCCTGGAATGGGTCGGAACCATGGGCT GGAACGACAAGAAGTACTACAACAGCGCCC TGAAGTCCCGGCTGAGCATCAGCAGAAACA CCAGCAAGAACCAGGTGTTCCTGAAGCTGA GCAGCCTGCAGACCGAGGACACCGCCATGT ACTACTGCACCAGGGACGGCGATAGCAGCG GCAGTTGGTTCGCCTATTGGGGCCAGGGCAC CCTGGTCACCGTGTCTAGTGCCAAAACAACA GCACCAAGTGTCTATCCACTGGCCCCTGTGT GTGGAGATACAACTGGCTCCTCGGTGACTCT AGGATGCCTGGTCAAGGGTTATTTCCCTGAG CCAGTGACCTTGACCTGGAACTCTGGATCCC TGTCCAGTGGTGTGCACACCTTCCCAGCTGT CCTGCAGTCTGACCTCTACACCCTCAGCAGC TCAGTGACTGTAACCTCGAGCACCTGGCCCA GCCAGTCCATCACCTGCAATGTGGCCCACCC GGCAAGCAGCACCAAGGTGGACAAGAAAAT TGAGCCCAGAGGGCCCACAATCAAGCCCTG TCCTCCATGCAAATGCCCAGCACCTAACCTC TTGGGTGGACCATCCGTCTTCATCTTCCCTCC AAAGATCAAGGATGTACTCATGATCTCCCTG AGCCCCATAGTCACATGTGTGGTGGTGGATG TGAGCGAGGATGACCCAGATGTCCAGATCA GCTGGTTTGTGAACAACGTGGAAGTACACA CAGCTCAGACACAAACCCATAGAGAGGATT ACAACAGTACTCTCCGGGTGGTCAGTGCCCT CCCCATCCAGCACCAGGACTGGATGAGTGG CAAGGAGTTCAAATGCAAGGTCAACAACAA AGACCTCCCAGCGCCCATCGAGAGAACCAT CTCAAAACCCAAAGGGTCAGTAAGAGCTCC ACAGGTATATGTCTTGCCTCCACCAGAAGAA GAGATGACTAAGAAACAGGTCACTCTGACC TGCATGGTCACAGACTTCATGCCTGAAGACA TTTACGTGGAGTGGACCAACAACGGGAAAA CAGAGCTAAACTACAAGAACACTGAACCAG TCCTGGACTCTGATGGTTCTTACTTCATGTAC AGCAAGCTGAGAGTGGAAAAGAAGAACTGG GTGGAAAGAAATAGCTACTCCTGTTCAGTGG TCCACGAGGGTCTGCACAATCACCACACGA CTAAGAGCTTCTCCCGGACTCCGGGTAAATG A | 897 |
| SM1B258 | pDR000030232 | ATGGCTTGGGTGTGGACCTTGCTATTCCTGA TGGCAGCTGCCCAAAGTATACAGGCCCAGG TGCAGCTGAAAGAGTCCGGCCCTGATCTGGT GCAGCCCAGCCAGACCCTGAGCCTGACCTGT ACCGTGTCCGGCTTCAGCCTGACAGGCTACG CTGTGCATTGGGTCCGACAGCCTCCAGGCAA GGGCGTGGAATGGGTCGGAACCATGGGCTG GGACGACAAGAAGTTCTACAACAGCGCCCT GAAGTCCCGGCTGAGCATCTCCAGGGACCC CAGCAAGAACCAGGTGTTCTTCAAGCTGAG CAGCCTGCAGACCGAGGACACCGCCATGTA CTACTGCACCAGGGATCACGGCGACGGCGG CTTTGCCTATTGGGGCCAGGGAACCCTGGTC ACCGTGTCCTCTGCCAAAACAACAGCACCA AGTGTCTATCCACTGGCCCCTGTGTGTGGAG ATACAACTGGCTCCTCGGTGACTCTAGGATG CCTGGTCAAGGGTTATTTCCCTGAGCCAGTG ACCTTGACCTGGAACTCTGGATCCCTGTCCA GTGGTGTGCACACCTTCCCAGCTGTCCTGCA GTCTGACCTCTACACCCTCAGCAGCTCAGTG ACTGTAACCTCGAGCACCTGGCCCAGCCAGT CCATCACCTGCAATGTGGCCCACCCGGCAAG CAGCACCAAGGTGGACAAGAAAATTGAGCC CAGAGGGCCCACAATCAAGCCCTGTCCTCCA TGCAAATGCCCAGCACCTAACCTCTTGGGTG | 898 |

TABLE 27-continued

LukAB Antibody Heavy Chain Primary Transcripts

| mAB/<br>Fab name | Con-<br>struct ID | Heavy Chain Primary Transcript | SEQ ID NO: |
|---|---|---|---|
| | | GACCATCCGTCTTCATCTTCCCTCCAAAGAT<br>CAAGGATGTACTCATGATCTCCCTGAGCCCC<br>ATAGTCACATGTGTGGTGGTGGATGTGAGCG<br>AGGATGACCCAGATGTCCAGATCAGCTGGTT<br>TGTGAACAACGTGGAAGTACACACAGCTCA<br>GACACAAACCCATAGAGAGGATTACAACAG<br>TACTCTCCGGGTGGTCAGTGCCCTCCCCATC<br>CAGCACCAGGACTGGATGAGTGGCAAGGAG<br>TTCAAATGCAAGGTCAACAACAAAGACCTC<br>CCAGCGCCCATCGAGAGAACCATCTCAAAA<br>CCCAAAGGGTCAGTAAGAGCTCCACAGGTA<br>TATGTCTTGCCTCCACCAGAAGAAGAGATGA<br>CTAAGAAACAGGTCACTCTGACCTGCATGGT<br>CACAGACTTCATGCCTGAAGACATTTACGTG<br>GAGTGGACCAACAACGGGAAAACAGAGCTA<br>AACTACAAGAACACTGAACCAGTCCTGGAC<br>TCTGATGGTTCTTACTTCATGTACAGCAAGC<br>TGAGAGTGGAAAAGAAGAACTGGGTGGAAA<br>GAAATAGCTACTCCTGTTCAGTGGTCCACGA<br>GGGTCTGCACAATCACCACACGACTAAGAG<br>CTTCTCCCGGACTCCGGGTAAATGA | |
| SM1B259 | pDR000030<br>233 | ATGGCTTGGGTGTGGACCTTGCTATTCCTGA<br>TGGCAGCTGCCCAAAGTATACAGGCCGAAG<br>TCCAGCTGCAGCAGTCTGGCCCTGAGCTGGT<br>CAAGCCTGGGGCCAGCGTGAAGATCCCATG<br>CAAGGCCAGCGGCTACACCTTCACCGACTAC<br>AACATGGACTGGGTCAAGCAGAGCCACGGC<br>AAGAGCCTGGAATGGATCGGCAACATCAAC<br>CCCAACAACGGCGGCACCATCTACAACCAG<br>AACTTCAAGGACCGGGCCACCCTGACCGTG<br>GACAAGAGCAGCAGCACCGCCTACATGGAA<br>CTGCGGAGCCTGACCAGCGAGGACACCGCC<br>GTGTACTACTGCACCAGAGAGAACTCCGGCT<br>ACGGCGGCAACTACTTCGCCTATTGGGGCCA<br>GGGCACCACACTGACAGTGTCCTCTGCCAAA<br>ACAACAGCACCAAGTGTCTATCCACTGGCCC<br>CTGTGTGTGGAGATACAACTGGCTCCTCGGT<br>GACTCTAGGATGCCTGGTCAAGGGGTTATTTC<br>CCTGAGCCAGTGACCTTGACCTGGAACTCTG<br>GATCCCTGTCCAGTGGTGTGCACACCTTCCC<br>AGCTGTCCTGCAGTCTGACCTCTACACCCTC<br>AGCAGCTCAGTGACTGTAACCTCGAGCACCT<br>GGCCCAGCCAGTCCATCACCTGCAATGTGGC<br>CCACCCGGCAAGCAGCACCAAGGTGGACAA<br>GAAAATTGAGCCCAGAGGGCCCACAATCAA<br>GCCCTGTCCTCCATGCAAATGCCCAGCACCT<br>AACCTCTTGGGTGGACCATCCGTCTTCATCT<br>TCCCTCCAAAGATCAAGGATGTACTCATGAT<br>CTCCCTGAGCCCCATAGTCACATGTGTGGTG<br>GTGGATGTGAGCGAGGATGACCCAGATGTC<br>CAGATCAGCTGGTTTGTGAACAACGTGGAA<br>GTACACACAGCTCAGACACAAACCCATAGA<br>GAGGATTACAACAGTACTCTCCGGGTGGTCA<br>GTGCCCTCCCCATCCAGCACCAGGACTGGAT<br>GAGTGGCAAGGAGTTCAAATGCAAGGTCAA<br>CAACAAAGACCTCCCAGCGCCCATCGAGAG<br>AACCATCTCAAAACCCAAAGGGTCAGTAAG<br>AGCTCCACAGGTATATGTCTTGCCTCCACCA<br>GAAGAAGAGATGACTAAGAAACAGGTCACT<br>CTGACCTGCATGGTCACAGACTTCATGCCTG<br>AAGACATTTACGTGGAGTGGACCAACAACG<br>GGAAAACAGAGCTAAACTACAAGAACACTG<br>AACCAGTCCTGGACTCTGATGGTTCTTACTT<br>CATGTACAGCAAGCTGAGAGTGGAAAAGAA<br>GAACTGGGTGGAAAGAAATAGCTACTCCTG<br>TTCAGTGGTCCACGAGGGTCTGCACAATCAC<br>CACACGACTAAGAGCTTCTCCCGGACTCCGG<br>GTAAATGA | 899 |
| SM1B260 | pDR000030<br>234 | ATGGCTTGGGTGTGGACCTTGCTATTCCTGA<br>TGGCAGCTGCCCAAAGTATACAGGCCGAAG<br>TCCAGCTGCAGCAGAGCGGAGCCGAACTCG | 900 |

TABLE 27-continued

LukAB Antibody Heavy Chain Primary Transcripts

| mAB/Fab name | Construct ID | Heavy Chain Primary Transcript | SEQ ID NO: |
|---|---|---|---|
| | | TCAGACCTGGCGCTTCCGTGAAGCTGAGCTG<br>CACCACCAGCGGCTTCAACATCAAGGACAG<br>CCTGATCTACTGGGTCAAGCAGCGGCCCGA<br>GCAGGGCCTGGAATGGATCGGCTGGATTGA<br>CCCCGAGGACGGCGAGACAAAGTTCGCCCC<br>TAGATTCCAGGACAAGGCCACCATCACCAG<br>CGACACCAGCAGCAACACCGCCTACCTGAG<br>ACTGAGCAGCCTGACCAGCGAGGACACCGC<br>CATCTACTACTGCACCCGGTCCTTCGGCGTG<br>TGTTGGGGCCAGGGAACCCTGGTCACAGTGT<br>CTGCTGCCAAAACAACAGCACCAAGTGTCT<br>ATCCACTGGCCCCTGTGTGTGGAGATACAAC<br>TGGCTCCTCGGTGACTCTAGGATGCCTGGTC<br>AAGGGTTATTTCCCTGAGCCAGTGACCTTGA<br>CCTGGAACTCTGGATCCCTGTCCAGTGGTGT<br>GCACACCTTCCCAGCTGTCCTGCAGTCTGAC<br>CTCTACACCCTCAGCAGCTCAGTGACTGTAA<br>CCTCGAGCACCTGGCCCAGCCAGTCCATCAC<br>CTGCAATGTGGCCCACCCGGCAAGCAGCAC<br>CAAGGTGGACAAGAAAATTGAGCCCAGAGG<br>GCCCACAATCAAGCCCTGTCCTCCATGCAAA<br>TGCCCAGCACCTAACCTCTTGGGTGGACCAT<br>CCGTCTTCATCTTCCCTCCAAAGATCAAGGA<br>TGTACTCATGATCTCCCTGAGCCCCATAGTC<br>ACATGTGTGGTGGTGGATGTGAGCGAGGAT<br>GACCCAGATGTCCAGATCAGCTGGTTTGTGA<br>ACAACGTGGAAGTACACAGCTCAGACAC<br>AAACCCATAGAGAGGATTACAACAGTACTC<br>TCCGGGTGGTCAGTGCCCTCCCCATCCAGCA<br>CCAGGACTGGATGAGTGGCAAGGAGTTCAA<br>ATGCAAGGTCAACAACAAAGACCTCCCAGC<br>GCCCATCGAGAGAACCATCTCAAAACCCAA<br>AGGGTCAGTAAGAGCTCCACAGGTATATGT<br>CTTGCCTCCACCAGAAGAAGAGATGACTAA<br>GAAACAGGTCACTCTGACCTGCATGGTCACA<br>GACTTCATGCCTGAAGACATTTACGTGGAGT<br>GGACCAACAACGGGAAAACAGAGCTAAACT<br>ACAAGAACACTGAACCAGTCCTGGACTCTG<br>ATGGTTCTTACTTCATGTACAGCAAGCTGAG<br>AGTGGAAAAGAAGAACTGGGTGGAAAGAA<br>ATAGCTACTCCTGTTCAGTGGTCCACGAGGG<br>TCTGCACAATCACCACACGACTAAGAGCTTC<br>TCCCGGACTCCGGGTAAATGA | |
| SM1B261 | pDR000030234 | ATGGCTTGGGTGTGGACCTTGCTATTCCTGA<br>TGGCAGCTGCCCAAAGTATACAGGCCGAAG<br>TCCAGCTGCAGCAGAGCGGAGCCGAACTCG<br>TCAGACCTGGCGCTTCCGTGAAGCTGAGCTG<br>CACCACCAGCGGCTTCAACATCAAGGACAG<br>CCTGATCTACTGGGTCAAGCAGCGGCCCGA<br>GCAGGGCCTGGAATGGATCGGCTGGATTGA<br>CCCCGAGGACGGCGAGACAAAGTTCGCCCC<br>TAGATTCCAGGACAAGGCCACCATCACCAG<br>CGACACCAGCAGCAACACCGCCTACCTGAG<br>ACTGAGCAGCCTGACCAGCGAGGACACCGC<br>CATCTACTACTGCACCCGGTCCTTCGGCGTG<br>TGTTGGGGCCAGGGAACCCTGGTCACAGTGT<br>CTGCTGCCAAAACAACAGCACCAAGTGTCT<br>ATCCACTGGCCCCTGTGTGTGGAGATACAAC<br>TGGCTCCTCGGTGACTCTAGGATGCCTGGTC<br>AAGGGTTATTTCCCTGAGCCAGTGACCTTGA<br>CCTGGAACTCTGGATCCCTGTCCAGTGGTGT<br>GCACACCTTCCCAGCTGTCCTGCAGTCTGAC<br>CTCTACACCCTCAGCAGCTCAGTGACTGTAA<br>CCTCGAGCACCTGGCCCAGCCAGTCCATCAC<br>CTGCAATGTGGCCCACCCGGCAAGCAGCAC<br>CAAGGTGGACAAGAAAATTGAGCCCAGAGG<br>GCCCACAATCAAGCCCTGTCCTCCATGCAAA<br>TGCCCAGCACCTAACCTCTTGGGTGGACCAT<br>CCGTCTTCATCTTCCCTCCAAAGATCAAGGA<br>TGTACTCATGATCTCCCTGAGCCCCATAGTC<br>ACATGTGTGGTGGTGGATGTGAGCGAGGAT<br>GACCCAGATGTCCAGATCAGCTGGTTTGTGA<br>ACAACGTGGAAGTACACAGCTCAGACAC | 901 |

TABLE 27-continued

LukAB Antibody Heavy Chain Primary Transcripts

| mAB/Fab name | Construct ID | Heavy Chain Primary Transcript | SEQ ID NO: |
|---|---|---|---|
| | | AAACCCATAGAGAGGATTACAACAGTACTC<br>TCCGGGTGGTCAGTGCCCTCCCCATCCAGCA<br>CCAGGACTGGATGAGTGGCAAGGAGTTCAA<br>ATGCAAGGTCAACAACAAAGACCTCCCAGC<br>GCCCATCGAGAGAACCATCTCAAAACCCAA<br>AGGGTCAGTAAGAGCTCCACAGGTATATGT<br>CTTGCCTCCACCAGAAGAAGAGATGACTAA<br>GAAACAGGTCACTCTGACCTGCATGGTCACA<br>GACTTCATGCCTGAAGACATTTACGTGGAGT<br>GGACCAACAACGGGAAAACAGAGCTAAACT<br>ACAAGAACACTGAACCAGTCCTGGACTCTG<br>ATGGTTCTTACTTCATGTACAGCAAGCTGAG<br>AGTGGAAAAGAAGAACTGGGTGGAAAGAA<br>ATAGCTACTCCTGTTCAGTGGTCCACGAGGG<br>TCTGCACAATCACCACACGACTAAGAGCTTC<br>TCCCGGACTCCGGGTAAATGA | |
| SM1B262 | pDR000030234 | ATGGCTTGGGTGTGGACCTTGCTATTCCTGA<br>TGGCAGCTGCCCAAAGTATACAGGCCGAAG<br>TCCAGCTGCAGCAGAGCGGAGCCGAACTCG<br>TCAGACCTGGCGCTTCCGTGAAGCTGAGCTG<br>CACCACCAGCGGCTTCAACATCAAGGACAG<br>CCTGATCTACTGGGTCAAGCAGCGGCCCGA<br>GCAGGGCCTGGAATGGATCGGCTGGATTGA<br>CCCCGAGGACGGCGAGACAAAGTTCGCCCC<br>TAGATTCCAGGACAAGGCCACCATCACCAG<br>CGACACCAGCAGCAACACCGCCTACCTGAG<br>ACTGAGCAGCCTGACCAGCGAGGACACCGC<br>CATCTACTACTGCACCCGGTCCTTCGGCGTG<br>TGTTGGGGCCAGGGAACCCTGGTCACAGTGT<br>CTGCTGCCAAAACAACAGCACCAAGTGTCT<br>ATCCACTGGCCCCTGTGTGTGGAGATACAAC<br>TGGCTCCTCGGTGACTCTAGGATGCCTGGTC<br>AAGGGTTATTTCCCTGAGCCAGTGACCTTGA<br>CCTGGAACTCTGGATCCCTGTCCAGTGGTGT<br>GCACACCTTCCCAGCTGTCCTGCAGTCTGAC<br>CTCTACACCCTCAGCAGCTCAGTGACTGTAA<br>CCTCGAGCACCTGGCCCAGCCAGTCCATCAC<br>CTGCAATGTGGCCCACCCGGCAAGCAGCAC<br>CAAGGTGGACAAGAAAATTGAGCCCAGAGG<br>GCCCACAATCAAGCCCTGTCCTCCATGCAAA<br>TGCCCAGCACCTAACCTCTTGGGTGGACCAT<br>CCGTCTTCATCTTCCCTCCAAAGATCAAGGA<br>TGTACTCATGATCTCCCTGAGCCCCATAGTC<br>ACATGTGTGGTGGTGGATGTGAGCGAGGAT<br>GACCCAGATGTCCAGATCAGCTGGTTTGTGA<br>ACAACGTGGAAGTACACACAGCTCAGACAC<br>AAACCCATAGAGAGGATTACAACAGTACTC<br>TCCGGGTGGTCAGTGCCCTCCCCATCCAGCA<br>CCAGGACTGGATGAGTGGCAAGGAGTTCAA<br>ATGCAAGGTCAACAACAAAGACCTCCCAGC<br>GCCCATCGAGAGAACCATCTCAAAACCCAA<br>AGGGTCAGTAAGAGCTCCACAGGTATATGT<br>CTTGCCTCCACCAGAAGAAGAGATGACTAA<br>GAAACAGGTCACTCTGACCTGCATGGTCACA<br>GACTTCATGCCTGAAGACATTTACGTGGAGT<br>GGACCAACAACGGGAAAACAGAGCTAAACT<br>ACAAGAACACTGAACCAGTCCTGGACTCTG<br>ATGGTTCTTACTTCATGTACAGCAAGCTGAG<br>AGTGGAAAAGAAGAACTGGGTGGAAAGAA<br>ATAGCTACTCCTGTTCAGTGGTCCACGAGGG<br>TCTGCACAATCACCACACGACTAAGAGCTTC<br>TCCCGGACTCCGGGTAAATGA | 902 |
| SM1B263 | pDR000030234 | ATGGCTTGGGTGTGGACCTTGCTATTCCTGA<br>TGGCAGCTGCCCAAAGTATACAGGCCGAAG<br>TCCAGCTGCAGCAGAGCGGAGCCGAACTCG<br>TCAGACCTGGCGCTTCCGTGAAGCTGAGCTG<br>CACCACCAGCGGCTTCAACATCAAGGACAG<br>CCTGATCTACTGGGTCAAGCAGCGGCCCGA<br>GCAGGGCCTGGAATGGATCGGCTGGATTGA<br>CCCCGAGGACGGCGAGACAAAGTTCGCCCC<br>TAGATTCCAGGACAAGGCCACCATCACCAG | 903 |

TABLE 27-continued

LukAB Antibody Heavy Chain Primary Transcripts

| mAB/Fab name | Construct ID | Heavy Chain Primary Transcript | SEQ ID NO: |
|---|---|---|---|
| | | CGACACCAGCAGCAACACCGCCTACCTGAG<br>ACTGAGCAGCCTGACCAGCGAGGACACCGC<br>CATCTACTACTGCACCCGGTCCTTCGGCGTG<br>TGTTGGGGCCAGGGAACCCTGGTCACAGTGT<br>CTGCTGCCAAAACAACAGCACCAAGTGTCT<br>ATCCACTGGCCCCTGTGTGTGGAGATACAAC<br>TGGCTCCTCGGTGACTCTAGGATGCCTGGTC<br>AAGGGTTATTTCCCTGAGCCAGTGACCTTGA<br>CCTGGAACTCTGGATCCCTGTCCAGTGGTGT<br>GCACACCTTCCCAGCTGTCCTGCAGTCTGAC<br>CTCTACACCCTCAGCAGCTCAGTGACTGTAA<br>CCTCGAGCACCTGGCCCAGCCAGTCCATCAC<br>CTGCAATGTGGCCCACCCGGCAAGCAGCAC<br>CAAGGTGGACAAGAAAATTGAGCCCAGAGG<br>GCCCACAATCAAGCCCTGTCCTCCATGCAAA<br>TGCCCAGCACCTAACCTCTTGGGTGGACCAT<br>CCGTCTTCATCTTCCCTCCAAAGATCAAGGA<br>TGTACTCATGATCTCCCTGAGCCCCATAGTC<br>ACATGTGTGGTGGTGGATGTGAGCGAGGAT<br>GACCCAGATGTCCAGATCAGCTGGTTTGTGA<br>ACAACGTGGAAGTACACACAGCTCAGACAC<br>AAACCCATAGAGAGGATTACAACAGTACTC<br>TCCGGGTGGTCAGTGCCCTCCCCATCCAGCA<br>CCAGGACTGGATGAGTGGCAAGGAGTTCAA<br>ATGCAAGGTCAACAACAAAGACCTCCCAGC<br>GCCCATCGAGAGAACCATCTCAAAACCCAA<br>AGGGTCAGTAAGAGCTCCACAGGTATATGT<br>CTTGCCTCCACCAGAAGAAGAGATGACTAA<br>GAAACAGGTCACTCTGACCTGCATGGTCACA<br>GACTTCATGCCTGAAGACATTTACGTGGAGT<br>GGACCAACAACGGGAAAACAGAGCTAAACT<br>ACAAGAACACTGAACCAGTCCTGGACTCTG<br>ATGGTTCTTACTTCATGTACAGCAAGCTGAG<br>AGTGGAAAAGAAGAACTGGGTGGAAAGAA<br>ATAGCTACTCCTGTTCAGTGGTCCACGAGGG<br>TCTGCACAATCACCACACGACTAAGAGCTTC<br>TCCCGGACTCCGGGTAAATGA | |
| SM1B264 | pDR000030234 | ATGGCTTGGGTGTGGACCTTGCTATTCCTGA<br>TGGCAGCTGCCCAAAGTATACAGGCCGAAG<br>TCCAGCTGCAGCAGAGCGGAGCCGAACTCG<br>TCAGACCTGGCGCTTCCGTGAAGCTGAGCTG<br>CACCACCAGCGGCTTCAACATCAAGGACAG<br>CCTGATCTACTGGGTCAAGCAGCGGCCCGA<br>GCAGGGCCTGGAATGGATCGGCTGGATTGA<br>CCCCGAGGACGGCGAGACAAAGTTCGCCCC<br>TAGATTCCAGGACAAGGCCACCATCACCAG<br>CGACACCAGCAGCAACACCGCCTACCTGAG<br>ACTGAGCAGCCTGACCAGCGAGGACACCGC<br>CATCTACTACTGCACCCGGTCCTTCGGCGTG<br>TGTTGGGGCCAGGGAACCCTGGTCACAGTGT<br>CTGCTGCCAAAACAACAGCACCAAGTGTCT<br>ATCCACTGGCCCCTGTGTGTGGAGATACAAC<br>TGGCTCCTCGGTGACTCTAGGATGCCTGGTC<br>AAGGGTTATTTCCCTGAGCCAGTGACCTTGA<br>CCTGGAACTCTGGATCCCTGTCCAGTGGTGT<br>GCACACCTTCCCAGCTGTCCTGCAGTCTGAC<br>CTCTACACCCTCAGCAGCTCAGTGACTGTAA<br>CCTCGAGCACCTGGCCCAGCCAGTCCATCAC<br>CTGCAATGTGGCCCACCCGGCAAGCAGCAC<br>CAAGGTGGACAAGAAAATTGAGCCCAGAGG<br>GCCCACAATCAAGCCCTGTCCTCCATGCAAA<br>TGCCCAGCACCTAACCTCTTGGGTGGACCAT<br>CCGTCTTCATCTTCCCTCCAAAGATCAAGGA<br>TGTACTCATGATCTCCCTGAGCCCCATAGTC<br>ACATGTGTGGTGGTGGATGTGAGCGAGGAT<br>GACCCAGATGTCCAGATCAGCTGGTTTGTGA<br>ACAACGTGGAAGTACACACAGCTCAGACAC<br>AAACCCATAGAGAGGATTACAACAGTACTC<br>TCCGGGTGGTCAGTGCCCTCCCCATCCAGCA<br>CCAGGACTGGATGAGTGGCAAGGAGTTCAA<br>ATGCAAGGTCAACAACAAAGACCTCCCAGC<br>GCCCATCGAGAGAACCATCTCAAAACCCAA<br>AGGGTCAGTAAGAGCTCCACAGGTATATGT | 904 |

TABLE 27-continued

LukAB Antibody Heavy Chain Primary Transcripts

| mAB/<br>Fab name | Con-<br>struct ID | Heavy Chain Primary Transcript | SEQ ID NO: |
|---|---|---|---|
| | | CTTGCCTCCACCAGAAGAAGAGATGACTAA<br>GAAACAGGTCACTCTGACCTGCATGGTCACA<br>GACTTCATGCCTGAAGACATTTACGTGGAGT<br>GGACCAACAACGGGAAAACAGAGCTAAACT<br>ACAAGAACACTGAACCAGTCCTGGACTCTG<br>ATGGTTCTTACTTCATGTACAGCAAGCTGAG<br>AGTGGAAAAGAAGAACTGGGTGGAAAGAA<br>ATAGCTACTCCTGTTCAGTGGTCCACGAGGG<br>TCTGCACAATCACCACACGACTAAGAGCTTC<br>TCCCGGACTCCGGGTAAATGA | |
| SM1B265 | pDR000030<br>234 | ATGGCTTGGGTGTGGACCTTGCTATTCCTGA<br>TGGCAGCTGCCCAAAGTATACAGGCCGAAG<br>TCCAGCTGCAGCAGAGCGGAGCCGAACTCG<br>TCAGACCTGGCGCTTCCGTGAAGCTGAGCTG<br>CACCACCAGCGGCTTCAACATCAAGGACAG<br>CCTGATCTACTGGGTCAAGCAGCGGCCCGA<br>GCAGGGCCTGGAATGGATCGGCTGGATTGA<br>CCCCGAGGACGGCGAGACAAAGTTCGCCCC<br>TAGATTCCAGGACAAGGCCACCATCACCAG<br>CGACACCAGCAGCAACACCGCCTACCTGAG<br>ACTGAGCAGCCTGACCAGCGAGGACACCGC<br>CATCTACTACTGCACCCGGTCCTTCGGCGTG<br>TGTTGGGGCCAGGGAACCCTGGTCACAGTGT<br>CTGCTGCCAAAACAACAGCACCAAGTGTCT<br>ATCCACTGGCCCCTGTGTGTGGAGATACAAC<br>TGGCTCCTCGGTGACTCTAGGATGCCTGGTC<br>AAGGGTTATTCCCTGAGCCAGTGACCTTGA<br>CCTGGAACTCTGGATCCCTGTCCAGTGGTGT<br>GCACACCTTCCCAGCTGTCCTGCAGTCTGAC<br>CTCTACACCCTCAGCAGCTCAGTGACTGTAA<br>CCTCGAGCACCTGGCCCAGCCAGTCCATCAC<br>CTGCAATGTGGCCCACCCGGCAAGCAGCAC<br>CAAGGTGGACAAGAAAATTGAGCCCAGAGG<br>GCCCACAATCAAGCCCTGTCCTCCATGCAAA<br>TGCCCAGCACCTAACCTCTTGGGTGGACCAT<br>CCGTCTTCATCTTCCCTCCAAAGATCAAGGA<br>TGTACTCATGATCTCCCTGAGCCCCATAGTC<br>ACATGTGTGGTGGTGGATGTGAGCGAGGAT<br>GACCCAGATGTCCAGATCAGCTGGTTTGTGA<br>ACAACGTGGAAGTACACACAGCTCAGACAC<br>AAACCCATAGAGAGGATTACAACAGTACTC<br>TCCGGGTGGTCAGTGCCCTCCCCATCCAGCA<br>CCAGGACTGGATGAGTGGCAAGGAGTTCAA<br>ATGCAAGGTCAACAACAAAGACCTCCCAGC<br>GCCCATCGAGAGAACCATCTCAAAACCCAA<br>AGGGTCAGTAAGAGCTCCACAGGTATATGT<br>CTTGCCTCCACCAGAAGAAGAGATGACTAA<br>GAAACAGGTCACTCTGACCTGCATGGTCACA<br>GACTTCATGCCTGAAGACATTTACGTGGAGT<br>GGACCAACAACGGGAAAACAGAGCTAAACT<br>ACAAGAACACTGAACCAGTCCTGGACTCTG<br>ATGGTTCTTACTTCATGTACAGCAAGCTGAG<br>AGTGGAAAAGAAGAACTGGGTGGAAAGAA<br>ATAGCTACTCCTGTTCAGTGGTCCACGAGGG<br>TCTGCACAATCACCACACGACTAAGAGCTTC<br>TCCCGGACTCCGGGTAAATGA | 905 |
| SM1B266 | pDR000030<br>234 | ATGGCTTGGGTGTGGACCTTGCTATTCCTGA<br>TGGCAGCTGCCCAAAGTATACAGGCCGAAG<br>TCCAGCTGCAGCAGAGCGGAGCCGAACTCG<br>TCAGACCTGGCGCTTCCGTGAAGCTGAGCTG<br>CACCACCAGCGGCTTCAACATCAAGGACAG<br>CCTGATCTACTGGGTCAAGCAGCGGCCCGA<br>GCAGGGCCTGGAATGGATCGGCTGGATTGA<br>CCCCGAGGACGGCGAGACAAAGTTCGCCCC<br>TAGATTCCAGGACAAGGCCACCATCACCAG<br>CGACACCAGCAGCAACACCGCCTACCTGAG<br>ACTGAGCAGCCTGACCAGCGAGGACACCGC<br>CATCTACTACTGCACCCGGTCCTTCGGCGTG<br>TGTTGGGGCCAGGGAACCCTGGTCACAGTGT<br>CTGCTGCCAAAACAACAGCACCAAGTGTCT<br>ATCCACTGGCCCCTGTGTGTGGAGATACAAC | 906 |

TABLE 27-continued

LukAB Antibody Heavy Chain Primary Transcripts

| mAB/<br>Fab name | Con-<br>struct ID | Heavy Chain Primary Transcript | SEQ ID NO: |
|---|---|---|---|
| | | TGGCTCCTCGGTGACTCTAGGATGCCTGGTC<br>AAGGGTTATTTCCCTGAGCCAGTGACCTTGA<br>CCTGGAACTCTGGATCCCTGTCCAGTGGTGT<br>GCACACCTTCCCAGCTGTCCTGCAGTCTGAC<br>CTCTACACCCTCAGCAGCTCAGTGACTGTAA<br>CCTCGAGCACCTGGCCCAGCCAGTCCATCAC<br>CTGCAATGTGGCCCACCCGGCAAGCAGCAC<br>CAAGGTGGACAAGAAAATTGAGCCCAGAGG<br>GCCCACAATCAAGCCCTGTCCTCCATGCAAA<br>TGCCCAGCACCTAACCTCTTGGGTGGACCAT<br>CCGTCTTCATCTTCCCTCCAAAGATCAAGGA<br>TGTACTCATGATCTCCCTGAGCCCCATAGTC<br>ACATGTGTGGTGGTGGATGTGAGCGAGGAT<br>GACCCAGATGTCCAGATCAGCTGGTTTGTGA<br>ACAACGTGGAAGTACACACAGCTCAGACAC<br>AAACCCATAGAGAGGATTACAACAGTACTC<br>TCCGGGTGGTCAGTGCCCTCCCCATCCAGCA<br>CCAGGACTGGATGAGTGGCAAGGAGTTCAA<br>ATGCAAGGTCAACAACAAAGACCTCCCAGC<br>GCCCATCGAGAGAACCATCTCAAAACCCAA<br>AGGGTCAGTAAGAGCTCCACAGGTATATGT<br>CTTGCCTCCACCAGAAGAAGAGATGACTAA<br>GAAACAGGTCACTCTGACCTGCATGGTCACA<br>GACTTCATGCCTGAAGACATTTACGTGGAGT<br>GGACCAACAACGGGAAAACAGAGCTAAACT<br>ACAAGAACACTGAACCAGTCCTGGACTCTG<br>ATGGTTCTTACTTCATGTACAGCAAGCTGAG<br>AGTGGAAAAGAAGAACTGGGTGGAAAGAA<br>ATAGCTACTCCTGTTCAGTGGTCCACGAGGG<br>TCTGCACAATCACCACACGACTAAGAGCTTC<br>TCCCGGACTCCGGGTAAATGA | |
| SM1B267 | pDR000030<br>234 | ATGGCTTGGGTGTGGACCTTGCTATTCCTGA<br>TGGCAGCTGCCCAAAGTATACAGGCCGAAG<br>TCCAGCTGCAGCAGAGCGGAGCGAACTCG<br>TCAGACCTGGCGCTTCCGTGAAGCTGAGCTG<br>CACCACCAGCGGCTTCAACATCAAGGACAG<br>CCTGATCTACTGGGTCAAGCAGCGGCCCGA<br>GCAGGGCCTGGAATGGATCGGCTGGATTGA<br>CCCCGAGGACGGCGAGACAAAGTTCGCCCC<br>TAGATTCCAGGACAAGGCCACCATCACCAG<br>CGACACCAGCAGCAACACCGCCTACCTGAG<br>ACTGAGCAGCCTGACCAGCGAGGACACCGC<br>CATCTACTACTGCACCCGGTCCTTCGGCGTG<br>TGTTGGGGCCAGGGAACCCTGGTCACAGTGT<br>CTGCTGCCAAAACAACAGCACCAAGTGTCT<br>ATCCACTGGCCCCTGTGTGTGGAGATACAAC<br>TGGCTCCTCGGTGACTCTAGGATGCCTGGTC<br>AAGGGTTATTTCCCTGAGCCAGTGACCTTGA<br>CCTGGAACTCTGGATCCCTGTCCAGTGGTGT<br>GCACACCTTCCCAGCTGTCCTGCAGTCTGAC<br>CTCTACACCCTCAGCAGCTCAGTGACTGTAA<br>CCTCGAGCACCTGGCCCAGCCAGTCCATCAC<br>CTGCAATGTGGCCCACCCGGCAAGCAGCAC<br>CAAGGTGGACAAGAAAATTGAGCCCAGAGG<br>GCCCACAATCAAGCCCTGTCCTCCATGCAAA<br>TGCCCAGCACCTAACCTCTTGGGTGGACCAT<br>CCGTCTTCATCTTCCCTCCAAAGATCAAGGA<br>TGTACTCATGATCTCCCTGAGCCCCATAGTC<br>ACATGTGTGGTGGTGGATGTGAGCGAGGAT<br>GACCCAGATGTCCAGATCAGCTGGTTTGTGA<br>ACAACGTGGAAGTACACACAGCTCAGACAC<br>AAACCCATAGAGAGGATTACAACAGTACTC<br>TCCGGGTGGTCAGTGCCCTCCCCATCCAGCA<br>CCAGGACTGGATGAGTGGCAAGGAGTTCAA<br>ATGCAAGGTCAACAACAAAGACCTCCCAGC<br>GCCCATCGAGAGAACCATCTCAAAACCCAA<br>AGGGTCAGTAAGAGCTCCACAGGTATATGT<br>CTTGCCTCCACCAGAAGAAGAGATGACTAA<br>GAAACAGGTCACTCTGACCTGCATGGTCACA<br>GACTTCATGCCTGAAGACATTTACGTGGAGT<br>GGACCAACAACGGGAAAACAGAGCTAAACT<br>ACAAGAACACTGAACCAGTCCTGGACTCTG<br>ATGGTTCTTACTTCATGTACAGCAAGCTGAG | 907 |

TABLE 27-continued

LukAB Antibody Heavy Chain Primary Transcripts

| mAB/Fab name | Construct ID | Heavy Chain Primary Transcript | SEQ ID NO: |
|---|---|---|---|
| | | AGTGGAAAAGAAGAACTGGGTGGAAAGAA<br>ATAGCTACTCCTGTTCAGTGGTCCACGAGGG<br>TCTGCACAATCACCACACGACTAAGAGCTTC<br>TCCCGGACTCCGGGTAAATGA | |
| SM1B268 | pDR000030234 | ATGGCTTGGGTGTGGACCTTGCTATTCCTGA<br>TGGCAGCTGCCCAAAGTATACAGGCCGAAG<br>TCCAGCTGCAGCAGAGCGGAGCCGAACTCG<br>TCAGACCTGGCGCTTCCGTGAAGCTGAGCTG<br>CACCACCAGCGGCTTCAACATCAAGGACAG<br>CCTGATCTACTGGGTCAAGCAGCGGCCCGA<br>GCAGGGCCTGGAATGGATCGGCTGGATTGA<br>CCCCGAGGACGGCGAGACAAAGTTCGCCCC<br>TAGATTCCAGGACAAGGCCACCATCACCAG<br>CGACACCAGCAGCAACACCGCCTACCTGAG<br>ACTGAGCAGCCTGACCAGCGAGGACACCGC<br>CATCTACTACTGCACCCGGTCCTTCGGCGTG<br>TGTTGGGGCCAGGGAACCCTGGTCACAGTGT<br>CTGCTGCCAAAACAACAGCACCAAGTGTCT<br>ATCCACTGGCCCCTGTGTGTGGAGATACAAC<br>TGGCTCCTCGGTGACTCTAGGATGCCTGGTC<br>AAGGGTTATTTCCCTGAGCCAGTGACCTTGA<br>CCTGGAACTCTGGATCCCTGTCCAGTGGTGT<br>GCACACCTTCCCAGCTGTCCTGCAGTCTGAC<br>CTCTACACCCTCAGCAGCTCAGTGACTGTAA<br>CCTCGAGCACCTGGCCCAGCCAGTCCATCAC<br>CTGCAATGTGGCCCACCCGGCAAGCAGCAC<br>CAAGGTGGACAAGAAAATTGAGCCCAGAGG<br>GCCCACAATCAAGCCCTGTCCTCCATGCAAA<br>TGCCCAGCACCTAACCTCTTGGGTGGACCAT<br>CCGTCTTCATCTTCCCTCCAAAGATCAAGGA<br>TGTACTCATGATCTCCCTGAGCCCCATAGTC<br>ACATGTGTGGTGGTGGATGTGAGCGAGGAT<br>GACCCAGATGTCCAGATCAGCTGGTTTGTGA<br>ACAACGTGGAAGTACACACAGCTCAGACAC<br>AAACCCATAGAGAGGATTACAACAGTACTC<br>TCCGGGTGGTCAGTGCCCTCCCCATCCAGCA<br>CCAGGACTGGATGAGTGGCAAGGAGTTCAA<br>ATGCAAGGTCAACAACAAAGACCTCCCAGC<br>GCCCATCGAGAGAACCATCTCAAAACCCAA<br>AGGGGTCAGTAAGAGCTCCACAGGTATATGT<br>CTTGCCTCCACCAGAAGAAGAGATGACTAA<br>GAAACAGGTCACTCTGACCTGCATGGTCACA<br>GACTTCATGCCTGAAGACATTTACGTGGAGT<br>GGACCAACAACGGGAAAACAGAGCTAAACT<br>ACAAGAACACTGAACCAGTCCTGGACTCTG<br>ATGGTTCTTACTTCATGTACAGCAAGCTGAG<br>AGTGGAAAAGAAGAACTGGGTGGAAAGAA<br>ATAGCTACTCCTGTTCAGTGGTCCACGAGGG<br>TCTGCACAATCACCACACGACTAAGAGCTTC<br>TCCCGGACTCCGGGTAAATGA | 908 |
| SM1B269 | pDR000030234 | ATGGCTTGGGTGTGGACCTTGCTATTCCTGA<br>TGGCAGCTGCCCAAAGTATACAGGCCGAAG<br>TCCAGCTGCAGCAGAGCGGAGCCGAACTCG<br>TCAGACCTGGCGCTTCCGTGAAGCTGAGCTG<br>CACCACCAGCGGCTTCAACATCAAGGACAG<br>CCTGATCTACTGGGTCAAGCAGCGGCCCGA<br>GCAGGGCCTGGAATGGATCGGCTGGATTGA<br>CCCCGAGGACGGCGAGACAAAGTTCGCCCC<br>TAGATTCCAGGACAAGGCCACCATCACCAG<br>CGACACCAGCAGCAACACCGCCTACCTGAG<br>ACTGAGCAGCCTGACCAGCGAGGACACCGC<br>CATCTACTACTGCACCCGGTCCTTCGGCGTG<br>TGTTGGGGCCAGGGAACCCTGGTCACAGTGT<br>CTGCTGCCAAAACAACAGCACCAAGTGTCT<br>ATCCACTGGCCCCTGTGTGTGGAGATACAAC<br>TGGCTCCTCGGTGACTCTAGGATGCCTGGTC<br>AAGGGTTATTTCCCTGAGCCAGTGACCTTGA<br>CCTGGAACTCTGGATCCCTGTCCAGTGGTGT<br>GCACACCTTCCCAGCTGTCCTGCAGTCTGAC<br>CTCTACACCCTCAGCAGCTCAGTGACTGTAA<br>CCTCGAGCACCTGGCCCAGCCAGTCCATCAC | 909 |

TABLE 27-continued

LukAB Antibody Heavy Chain Primary Transcripts

| mAB/<br>Fab name | Con-<br>struct ID | Heavy Chain Primary Transcript | SEQ ID NO: |
|---|---|---|---|
| | | CTGCAATGTGGCCCACCCGGCAAGCAGCAC<br>CAAGGTGGACAAGAAAATTGAGCCCAGAGG<br>GCCCACAATCAAGCCCTGTCCTCCATGCAAA<br>TGCCCAGCACCTAACCTCTTGGGTGGACCAT<br>CCGTCTTCATCTTCCCTCCAAAGATCAAGGA<br>TGTACTCATGATCTCCCTGAGCCCCATAGTC<br>ACATGTGTGGTGGTGGATGTGAGCGAGGAT<br>GACCCAGATGTCCAGATCAGCTGGTTTGTGA<br>ACAACGTGGAAGTACACACAGCTCAGACAC<br>AAACCCATAGAGAGGATTACAACAGTACTC<br>TCCGGGTGGTCAGTGCCCTCCCCATCCAGCA<br>CCAGGACTGGATGAGTGGCAAGGAGTTCAA<br>ATGCAAGGTCAACAACAAAGACCTCCCAGC<br>GCCCATCGAGAGAACCATCTCAAAACCCAA<br>AGGGTCAGTAAGAGCTCCACAGGTATATGT<br>CTTGCCTCCACCAGAAGAAGAGATGACTAA<br>GAAACAGGTCACTCTGACCTGCATGGTCACA<br>GACTTCATGCCTGAAGACATTTACGTGGAGT<br>GGACCAACAACGGGAAAACAGAGCTAAACT<br>ACAAGAACACTGAACCAGTCCTGGACTCTG<br>ATGGTTCTTACTTCATGTACAGCAAGCTGAG<br>AGTGGAAAAGAAGAACTGGGTGGAAAGAA<br>ATAGCTACTCCTGTTCAGTGGTCCACGAGGG<br>TCTGCACAATCACCACACGACTAAGAGCTTC<br>TCCCGGACTCCGGGTAAATGA | |
| SM1B270 | pDR000030<br>234 | ATGGCTTGGGTGTGGACCTTGCTATTCCTGA<br>TGGCAGCTGCCCAAAGTATACAGGCCGAAG<br>TCCAGCTGCAGCAGAGCGGAGCCGAACTCG<br>TCAGACCTGGCGCTTCCGTGAAGCTGAGCTG<br>CACCACCAGCGGCTTCAACATCAAGGACAG<br>CCTGATCTACTGGGTCAAGCAGCGGCCCGA<br>GCAGGGCCTGGAATGGATCGGCTGGATTGA<br>CCCCGAGGACGGCGAGACAAAGTTCGCCCC<br>TAGATTCCAGGACAAGGCCACCATCACCAG<br>CGACACCAGCAGCAACACCGCCTACCTGAG<br>ACTGAGCAGCCTGACCAGCGAGGACACCGC<br>CATCTACTACTGCACCCGGTCCTTCGGCGTG<br>TGTTGGGGCCAGGGAACCCTGGTCACAGTGT<br>CTGCTGCCAAAACAACAGCACCAAGTGTCT<br>ATCCACTGGCCCCTGTGTGTGGAGATACAAC<br>TGGCTCCTCGGTGACTCTAGGATGCCTGGTC<br>AAGGGTTATTTCCCTGAGCCAGTGACCTTGA<br>CCTGGAACTCTGGATCCCTGTCCAGTGGTGT<br>GCACACCTTCCCAGCTGTCCTGCAGTCTGAC<br>CTCTACACCCTCAGCAGCTCAGTGACTGTAA<br>CCTCGAGCACCTGGCCCAGCCAGTCCATCAC<br>CTGCAATGTGGCCCACCCGGCAAGCAGCAC<br>CAAGGTGGACAAGAAAATTGAGCCCAGAGG<br>GCCCACAATCAAGCCCTGTCCTCCATGCAAA<br>TGCCCAGCACCTAACCTCTTGGGTGGACCAT<br>CCGTCTTCATCTTCCCTCCAAAGATCAAGGA<br>TGTACTCATGATCTCCCTGAGCCCCATAGTC<br>ACATGTGTGGTGGTGGATGTGAGCGAGGAT<br>GACCCAGATGTCCAGATCAGCTGGTTTGTGA<br>ACAACGTGGAAGTACACACAGCTCAGACAC<br>AAACCCATAGAGAGGATTACAACAGTACTC<br>TCCGGGTGGTCAGTGCCCTCCCCATCCAGCA<br>CCAGGACTGGATGAGTGGCAAGGAGTTCAA<br>ATGCAAGGTCAACAACAAAGACCTCCCAGC<br>GCCCATCGAGAGAACCATCTCAAAACCCAA<br>AGGGTCAGTAAGAGCTCCACAGGTATATGT<br>CTTGCCTCCACCAGAAGAAGAGATGACTAA<br>GAAACAGGTCACTCTGACCTGCATGGTCACA<br>GACTTCATGCCTGAAGACATTTACGTGGAGT<br>GGACCAACAACGGGAAAACAGAGCTAAACT<br>ACAAGAACACTGAACCAGTCCTGGACTCTG<br>ATGGTTCTTACTTCATGTACAGCAAGCTGAG<br>AGTGGAAAAGAAGAACTGGGTGGAAAGAA<br>ATAGCTACTCCTGTTCAGTGGTCCACGAGGG<br>TCTGCACAATCACCACACGACTAAGAGCTTC<br>TCCCGGACTCCGGGTAAATGA | 910 |

TABLE 27-continued

LukAB Antibody Heavy Chain Primary Transcripts

| mAB/<br>Fab name | Con-<br>struct ID | Heavy Chain Primary Transcript | SEQ ID NO: |
|---|---|---|---|
| SM1B271 | pDR000030234 | ATGGCTTGGGTGTGGACCTTGCTATTCCTGA<br>TGGCAGCTGCCCAAAGTATACAGGCCGAAG<br>TCCAGCTGCAGCAGAGCGGAGCCGAACTCG<br>TCAGACCTGGCGCTTCCGTGAAGCTGAGCTG<br>CACCACCAGCGGCTTCAACATCAAGGACAG<br>CCTGATCTACTGGGTCAAGCAGCGGCCCGA<br>GCAGGGCCTGGAATGGATCGGCTGGATTGA<br>CCCCGAGGACGGCGAGACAAAGTTCGCCCC<br>TAGATTCCAGGACAAGGCCACCATCACCAG<br>CGACACCAGCAGCAACACCGCCTACCTGAG<br>ACTGAGCAGCCTGACCAGCGAGGACACCGC<br>CATCTACTACTGCACCCGGTCCTTCGGCGTG<br>TGTTGGGGCCAGGGAACCCTGGTCACAGTGT<br>CTGCTGCCAAAACAACAGCACCAAGTGTCT<br>ATCCACTGGCCCCTGTGTGTGGAGATACAAC<br>TGGCTCCTCGGTGACTCTAGGATGCCTGGTC<br>AAGGGTTATTTCCCTGAGCCAGTGACCTTGA<br>CCTGGAACTCTGGATCCCTGTCCAGTGGTGT<br>GCACACCTTCCCAGCTGTCCTGCAGTCTGAC<br>CTCTACACCCTCAGCAGCTCAGTGACTGTAA<br>CCTCGAGCACCTGGCCCAGCCAGTCCATCAC<br>CTGCAATGTGGCCCACCCGGCAAGCAGCAC<br>CAAGGTGGACAAGAAAATTGAGCCCAGAGG<br>GCCCACAATCAAGCCCTGTCCTCCATGCAAA<br>TGCCCAGCACCTAACCTCTTGGGTGGACCAT<br>CCGTCTTCATCTTCCCTCCAAAGATCAAGGA<br>TGTACTCATGATCTCCCTGAGCCCCATAGTC<br>ACATGTGTGGTGGTGGATGTGAGCGAGGAT<br>GACCCAGATGTCCAGATCAGCTGGTTTGTGA<br>ACAACGTGGAAGTACACACAGCTCAGACAC<br>AAACCCATAGAGAGGATTACAACAGTACTC<br>TCCGGGTGGTCAGTGCCCTCCCCATCCAGCA<br>CCAGGACTGGATGAGTGGCAAGGAGTTCAA<br>ATGCAAGGTCAACAACAAAGACCTCCCAGC<br>GCCCATCGAGAGAACCATCTCAAAACCCAA<br>AGGGTCAGTAAGAGCTCCACAGGTATATGT<br>CTTGCCTCCACCAGAAGAAGAGATGACTAA<br>GAAACAGGTCACTCTGACCTGCATGGTCACA<br>GACTTCATGCCTGAAGACATTTACGTGGAGT<br>GGACCAACAACGGGAAAACAGAGCTAAACT<br>ACAAGAACACTGAACCAGTCCTGGACTCTG<br>ATGGTTCTTACTTCATGTACAGCAAGCTGAG<br>AGTGGAAAAGAAGAACTGGGTGGAAAGAA<br>ATAGCTACTCCTGTTCAGTGGTCCACGAGGG<br>TCTGCACAATCACCACACGACTAAGAGCTTC<br>TCCCGGACTCCGGGTAAATGA | 911 |
| SM1B272 | pDR000030234 | ATGGCTTGGGTGTGGACCTTGCTATTCCTGA<br>TGGCAGCTGCCCAAAGTATACAGGCCGAAG<br>TCCAGCTGCAGCAGAGCGGAGCCGAACTCG<br>TCAGACCTGGCGCTTCCGTGAAGCTGAGCTG<br>CACCACCAGCGGCTTCAACATCAAGGACAG<br>CCTGATCTACTGGGTCAAGCAGCGGCCCGA<br>GCAGGGCCTGGAATGGATCGGCTGGATTGA<br>CCCCGAGGACGGCGAGACAAAGTTCGCCCC<br>TAGATTCCAGGACAAGGCCACCATCACCAG<br>CGACACCAGCAGCAACACCGCCTACCTGAG<br>ACTGAGCAGCCTGACCAGCGAGGACACCGC<br>CATCTACTACTGCACCCGGTCCTTCGGCGTG<br>TGTTGGGGCCAGGGAACCCTGGTCACAGTGT<br>CTGCTGCCAAAACAACAGCACCAAGTGTCT<br>ATCCACTGGCCCCTGTGTGTGGAGATACAAC<br>TGGCTCCTCGGTGACTCTAGGATGCCTGGTC<br>AAGGGTTATTTCCCTGAGCCAGTGACCTTGA<br>CCTGGAACTCTGGATCCCTGTCCAGTGGTGT<br>GCACACCTTCCCAGCTGTCCTGCAGTCTGAC<br>CTCTACACCCTCAGCAGCTCAGTGACTGTAA<br>CCTCGAGCACCTGGCCCAGCCAGTCCATCAC<br>CTGCAATGTGGCCCACCCGGCAAGCAGCAC<br>CAAGGTGGACAAGAAAATTGAGCCCAGAGG<br>GCCCACAATCAAGCCCTGTCCTCCATGCAAA<br>TGCCCAGCACCTAACCTCTTGGGTGGACCAT<br>CCGTCTTCATCTTCCCTCCAAAGATCAAGGA | 912 |

TABLE 27-continued

LukAB Antibody Heavy Chain Primary Transcripts

| mAB/<br>Fab name | Con-<br>struct ID | Heavy Chain Primary Transcript | SEQ ID NO: |
|---|---|---|---|
| | | TGTACTCATGATCTCCCTGAGCCCCATAGTC<br>ACATGTGTGGTGGTGGATGTGAGCGAGGAT<br>GACCCAGATGTCCAGATCAGCTGGTTTGTGA<br>ACAACGTGGAAGTACACACAGCTCAGACAC<br>AAACCCATAGAGAGGATTACAACAGTACTC<br>TCCGGGTGGTCAGTGCCCTCCCCATCCAGCA<br>CCAGGACTGGATGAGTGGCAAGGAGTTCAA<br>ATGCAAGGTCAACAACAAAGACCTCCCAGC<br>GCCCATCGAGAGAACCATCTCAAAACCCAA<br>AGGGTCAGTAAGAGCTCCACAGGTATATGT<br>CTTGCCTCCACCAGAAGAAGAGATGACTAA<br>GAAACAGGTCACTCTGACCTGCATGGTCACA<br>GACTTCATGCCTGAAGACATTTACGTGGAGT<br>GGACCAACAACGGGAAAACAGAGCTAAACT<br>ACAAGAACACTGAACCAGTCCTGGACTCTG<br>ATGGTTCTTACTTCATGTACAGCAAGCTGAG<br>AGTGGAAAAGAAGAACTGGGTGGAAAGAA<br>ATAGCTACTCCTGTTCAGTGGTCCACGAGGG<br>TCTGCACAATCACCACACGACTAAGAGCTTC<br>TCCCGGACTCCGGGTAAATGA | |
| SM1B273 | pDR000030<br>234 | ATGGCTTGGGTGTGGACCTTGCTATTCCTGA<br>TGGCAGCTGCCCAAAGTATACAGGCCGAAG<br>TCCAGCTGCAGCAGAGCGGAGCCGAACTCG<br>TCAGACCTGGCGCTTCCGTGAAGCTGAGCTG<br>CACCACCAGCGGCTTCAACATCAAGGACAG<br>CCTGATCTACTGGGTCAAGCAGCGGCCCGA<br>GCAGGGCCTGGAATGGATCGGCTGGATTGA<br>CCCCGAGGACGGCGAGACAAAGTTCGCCCC<br>TAGATTCCAGGACAAGGCCACCATCACCAG<br>CGACACCAGCAGCAACACCGCCTACCTGAG<br>ACTGAGCAGCCTGACCAGCGAGGACACCGC<br>CATCTACTACTGCACCCGGTCCTTCGGCGTG<br>TGTTGGGGCCAGGGAACCCTGGTCACAGTGT<br>CTGCTGCCAAAACAACAGCACCAAGTGTCT<br>ATCCACTGGCCCCTGTGTGTGGAGATACAAC<br>TGGCTCCTCGGTGACTCTAGGATGCCTGGTC<br>AAGGGTTATTTCCCTGAGCCAGTGACCTTGA<br>CCTGGAACTCTGGATCCCTGTCCAGTGGTGT<br>GCACACCTTCCCAGCTGTCCTGCAGTCTGAC<br>CTCTACACCCTCAGCAGCTCAGTGACTGTAA<br>CCTCGAGCACCTGGCCCAGCCAGTCCATCAC<br>CTGCAATGTGGCCCACCCGGCAAGCAGCAC<br>CAAGGTGGACAAGAAAATTGAGCCCAGAGG<br>GCCCACAATCAAGCCCTGTCCTCCATGCAAA<br>TGCCCAGCACCTAACCTCTTGGGTGGACCAT<br>CCGTCTTCATCTTCCCTCCAAAGATCAAGGA<br>TGTACTCATGATCTCCCTGAGCCCCATAGTC<br>ACATGTGTGGTGGTGGATGTGAGCGAGGAT<br>GACCCAGATGTCCAGATCAGCTGGTTTGTGA<br>ACAACGTGGAAGTACACACAGCTCAGACAC<br>AAACCCATAGAGAGGATTACAACAGTACTC<br>TCCGGGTGGTCAGTGCCCTCCCCATCCAGCA<br>CCAGGACTGGATGAGTGGCAAGGAGTTCAA<br>ATGCAAGGTCAACAACAAAGACCTCCCAGC<br>GCCCATCGAGAGAACCATCTCAAAACCCAA<br>AGGGTCAGTAAGAGCTCCACAGGTATATGT<br>CTTGCCTCCACCAGAAGAAGAGATGACTAA<br>GAAACAGGTCACTCTGACCTGCATGGTCACA<br>GACTTCATGCCTGAAGACATTTACGTGGAGT<br>GGACCAACAACGGGAAAACAGAGCTAAACT<br>ACAAGAACACTGAACCAGTCCTGGACTCTG<br>ATGGTTCTTACTTCATGTACAGCAAGCTGAG<br>AGTGGAAAAGAAGAACTGGGTGGAAAGAA<br>ATAGCTACTCCTGTTCAGTGGTCCACGAGGG<br>TCTGCACAATCACCACACGACTAAGAGCTTC<br>TCCCGGACTCCGGGTAAATGA | 913 |
| SM1B274 | pDR000030<br>234 | ATGGCTTGGGTGTGGACCTTGCTATTCCTGA<br>TGGCAGCTGCCCAAAGTATACAGGCCGAAG<br>TCCAGCTGCAGCAGAGCGGAGCCGAACTCG<br>TCAGACCTGGCGCTTCCGTGAAGCTGAGCTG<br>CACCACCAGCGGCTTCAACATCAAGGACAG | 914 |

TABLE 27-continued

LukAB Antibody Heavy Chain Primary Transcripts

| mAB/Fab name | Construct ID | Heavy Chain Primary Transcript | SEQ ID NO: |
|---|---|---|---|
| | | CCTGATCTACTGGGTCAAGCAGCGGCCCGA<br>GCAGGGCCTGGAATGGATCGGCTGGATTGA<br>CCCCGAGGACGGCGAGACAAAGTTCGCCCC<br>TAGATTCCAGGACAAGGCCACCATCACCAG<br>CGACACCAGCAGCAACACCGCCTACCTGAG<br>ACTGAGCAGCCTGACCAGCGAGGACACCGC<br>CATCTACTACTGCACCCGGTCCTTCGGCGTG<br>TGTTGGGGCCAGGGAACCCTGGTCACAGTGT<br>CTGCTGCCAAAACAACAGCACCAAGTGTCT<br>ATCCACTGGCCCCTGTGTGTGGAGATACAAC<br>TGGCTCCTCGGTGACTCTAGGATGCCTGGTC<br>AAGGGTTATTTCCCTGAGCCAGTGACCTTGA<br>CCTGGAACTCTGGATCCCTGTCCAGTGGTGT<br>GCACACCTTCCCAGCTGTCCTGCAGTCTGAC<br>CTCTACACCCTCAGCAGCTCAGTGACTGTAA<br>CCTCGAGCACCTGGCCCAGCCAGTCCATCAC<br>CTGCAATGTGGCCCACCCGGCAAGCAGCAC<br>CAAGGTGGACAAGAAAATTGAGCCCAGAGG<br>GCCCACAATCAAGCCCTGTCCTCCATGCAAA<br>TGCCCAGCACCTAACCTCTTGGGTGGACCAT<br>CCGTCTTCATCTTCCCTCCAAAGATCAAGGA<br>TGTACTCATGATCTCCCTGAGCCCCATAGTC<br>ACATGTGTGGTGGTGGATGTGAGCGAGGAT<br>GACCCAGATGTCCAGATCAGCTGGTTTGTGA<br>ACAACGTGGAAGTACACACAGCTCAGACAC<br>AAACCCATAGAGAGGATTACAACAGTACTC<br>TCCGGGTGGTCAGTGCCCTCCCCATCCAGCA<br>CCAGGACTGGATGAGTGGCAAGGAGTTCAA<br>ATGCAAGGTCAACAACAAAGACCTCCCAGC<br>GCCCATCGAGAGAACCATCTCAAAACCCAA<br>AGGGTCAGTAAGAGCTCCACAGGTATATGT<br>CTTGCCTCCACCAGAAGAAGAGATGACTAA<br>GAAACAGGTCACTCTGACCTGCATGGTCACA<br>GACTTCATGCCTGAAGACATTTACGTGGAGT<br>GGACCAACAACGGGAAAACAGAGCTAAACT<br>ACAAGAACACTGAACCAGTCCTGGACTCTG<br>ATGGTTCTTACTTCATGTACAGCAAGCTGAG<br>AGTGGAAAAGAAGAACTGGGTGGAAAGAA<br>ATAGCTACTCCTGTTCAGTGGTCCACGAGGG<br>TCTGCACAATCACCACACGACTAAGAGCTTC<br>TCCCGGACTCCGGGTAAATGA | |
| SM1B275 | pDR000030234 | ATGGCTTGGGTGTGGACCTTGCTATTCCTGA<br>TGGCAGCTGCCCAAAGTATACAGGCCGAAG<br>TCCAGCTGCAGCAGAGCGGAGCCGAACTCG<br>TCAGACCTGGCGCTTCCGTGAAGCTGAGCTG<br>CACCACCAGCGGCTTCAACATCAAGGACAG<br>CCTGATCTACTGGGTCAAGCAGCGGCCCGA<br>GCAGGGCCTGGAATGGATCGGCTGGATTGA<br>CCCCGAGGACGGCGAGACAAAGTTCGCCCC<br>TAGATTCCAGGACAAGGCCACCATCACCAG<br>CGACACCAGCAGCAACACCGCCTACCTGAG<br>ACTGAGCAGCCTGACCAGCGAGGACACCGC<br>CATCTACTACTGCACCCGGTCCTTCGGCGTG<br>TGTTGGGGCCAGGGAACCCTGGTCACAGTGT<br>CTGCTGCCAAAACAACAGCACCAAGTGTCT<br>ATCCACTGGCCCCTGTGTGTGGAGATACAAC<br>TGGCTCCTCGGTGACTCTAGGATGCCTGGTC<br>AAGGGTTATTTCCCTGAGCCAGTGACCTTGA<br>CCTGGAACTCTGGATCCCTGTCCAGTGGTGT<br>GCACACCTTCCCAGCTGTCCTGCAGTCTGAC<br>CTCTACACCCTCAGCAGCTCAGTGACTGTAA<br>CCTCGAGCACCTGGCCCAGCCAGTCCATCAC<br>CTGCAATGTGGCCCACCCGGCAAGCAGCAC<br>CAAGGTGGACAAGAAAATTGAGCCCAGAGG<br>GCCCACAATCAAGCCCTGTCCTCCATGCAAA<br>TGCCCAGCACCTAACCTCTTGGGTGGACCAT<br>CCGTCTTCATCTTCCCTCCAAAGATCAAGGA<br>TGTACTCATGATCTCCCTGAGCCCCATAGTC<br>ACATGTGTGGTGGTGGATGTGAGCGAGGAT<br>GACCCAGATGTCCAGATCAGCTGGTTTGTGA<br>ACAACGTGGAAGTACACACAGCTCAGACAC<br>AAACCCATAGAGAGGATTACAACAGTACTC<br>TCCGGGTGGTCAGTGCCCTCCCCATCCAGCA | 915 |

TABLE 27-continued

LukAB Antibody Heavy Chain Primary Transcripts

| mAB/<br>Fab name | Con-<br>struct ID | Heavy Chain Primary Transcript | SEQ ID NO: |
|---|---|---|---|
| | | CCAGGACTGGATGAGTGGCAAGGAGTTCAA<br>ATGCAAGGTCAACAACAAAGACCTCCCAGC<br>GCCCATCGAGAGAACCATCTCAAAACCCAA<br>AGGGTCAGTAAGAGCTCCACAGGTATATGT<br>CTTGCCTCCACCAGAAGAAGAGATGACTAA<br>GAAACAGGTCACTCTGACCTGCATGGTCACA<br>GACTTCATGCCTGAAGACATTTACGTGGAGT<br>GGACCAACAACGGGAAAACAGAGCTAAACT<br>ACAAGAACACTGAACCAGTCCTGGACTCTG<br>ATGGTTCTTACTTCATGTACAGCAAGCTGAG<br>AGTGGAAAAGAAGAACTGGGTGGAAAGAA<br>ATAGCTACTCCTGTTCAGTGGTCCACGAGGG<br>TCTGCACAATCACCACACGACTAAGAGCTTC<br>TCCCGGACTCCGGGTAAATGA | |

TABLE 28

LukAB Antibody Light Chain CDSs

| mAB/<br>Fab name | Con-<br>struct ID | Light Chain CDS | SEQ ID NO: |
|---|---|---|---|
| SM1B105 | pDR000023603 | GATATTGTGCTAACTCAGTCTCCAGCAATAA<br>TGGCTGCCTCTCTGGGGCAGAAGGTCACCAT<br>GACCTGCAGTGCCAGCTCAAGTGTAAGTTCC<br>AGTTACTTGCACTGGTACCAGCAGAAGTCAG<br>GCGCTTCCCCCAAACCCTTGATTCATAGGAC<br>ATCCAACCTGGCTTCTGGAGTCCCAGCTCGCT<br>TCAGTGGCAGTGGGTCTGGGACCTCTTACTCT<br>CTCACAATCAGCAGCGTGGAGGCTGAAGATG<br>ATGCAACTTATTACTGCCAGCAGTGGAGTGG<br>TTACCCATTCACGTTCGGTGCTGGGACCAAG<br>CTGGAGCTGAAACGGGCTGATGCTGCACCAA<br>CTGTATCCATCTTCCCACCATCCAGTGAGCAG<br>TTAACATCTGGAGGTGCCTCAGTCGTGTGCTT<br>CTTGAACAACTTCTACCCCAAAGACATCAAT<br>GTCAAGTGGAAGATTGATGGCAGTGAACGAC<br>AAAATGGCGTCCTGAACAGTTGGACTGATCA<br>GGACAGCAAAGACAGCACCTACAGCATGAG<br>CAGCACCCTCACGTTGACCAAGGACGAGTAT<br>GAACGACATAACAGCTATACCTGTGAGGCCA<br>CTCACAAGACATCAACTTCACCCATTGTCAA<br>GAGCTTCAACAGGAATGAGTGT | 916 |
| SM1B106 | pDR000023628 | GACATTGTGATGACCCAGTCTCCAGCTTCTTT<br>GGCTGTGTCTCTAGGGCAGAGGGCCACCATC<br>TCCTGCAGAGCCAGCGAAAGTGTTGATAATT<br>CTGGCATTAGTTTTATGAACTGGTTCCAACAG<br>AAACCAGGACAGCCACCCAAACTCCTCATCT<br>ATGCTGCATCCAACCAAGGATCCGGGGTCCC<br>TGCCAGGTTTAGTGGCAGTGGGTCTGGGACA<br>GACTTCAGCCTCAACATCCATCCTATGGAGG<br>AGGATGATACTGCAATGTATTTCTGTCAGCA<br>AAGTAAGGAGGTTCCGTACACGTTCGGAGGG<br>GGGACCAAGCTGGAAATAAAACGGGCTGAT<br>GCTGCACCAACTGTATCCATCTTCCCACCATC<br>CAGTGAGCAGTTAACATCTGGAGGTGCCTCA<br>GTCGTGTGCTTCTTGAACAACTTCTACCCCAA<br>AGACATCAATGTCAAGTGGAAGATTGATGGC<br>AGTGAACGACAAAATGGCGTCCTGAACAGTT<br>GGACTGATCAGGACAGCAAAGACAGCACCT<br>ACAGCATGAGCAGCACCCTCACGTTGACCAA<br>GGACGAGTATGAACGACATAACAGCTATACC<br>TGTGAGGCCACTCACAAGACATCAACTTCAC<br>CCATTGTCAAGAGCTTCAACAGGAATGAGTG<br>T | 917 |
| SM1B107 | pDR000023626 | GATATTGTGCTAACTCAGTCTCCAGCTTCTTT<br>GGCTGTGTCTCTAGGGCAGAGGGCCACCATC<br>TCCTGCAGAGCCAGCGAAAGTGTTGATAATT | 918 |

TABLE 28-continued

LukAB Antibody Light Chain CDSs

| mAB/Fab name | Construct ID | Light Chain CDS | SEQ ID NO: |
|---|---|---|---|
| | | CTGGCATTAGTTTTATGAACTGGTTCCAACAG AAACCAGGACAGCCACCCAAACTCCTCATCT ATGCTGCATCCAACCAAGGATCCGGGGTCCC TGCCAGGTTTAGTGGCAGTGGGTCTGGGACA GACTTCAGCCTCAACATCCATCCTATGGAGG AGGATGATACTGCAATGTATTTCTGTCAGCA AAGTAAGGAGGTTCCGTACACGTTCGGAGGG GGGACCAAGCTGGAAATAAAACGGGCTGAT GCTGCACCAACTGTATCCATCTTCCCACCATC CAGTGAGCAGTTAACATCTGGAGGTGCCTCA GTCGTGTGCTTCTTGAACAACTTCTACCCCAA AGACATCAATGTCAAGTGGAAGATTGATGGC AGTGAACGACAAAATGGCGTCCTGAACAGTT GGACTGATCAGGACAGCAAAGACAGCACCT ACAGCATGAGCAGCACCCTCACGTTGACCAA GGACGAGTATGAACGACATAACAGCTATACC TGTGAGGCCACTCACAAGACATCAACTTCAC CCATTGTCAAGAGCTTCAACAGGAATGAGTG T | |
| SM1B108 | pDR000023 627 | GATGTTGTGATGACCCAAACTCCCAAATTCC TGCTTGTATCAGCAGGAGACAGGGTTACCAT TACCTGCAAGGCCAGTCAGAGTGTGAGTGAT GATGTAACTTGGTACCAACAGAAGTCAGGAC AGTCTCCTAAACTGCTGATATACTATGCATCC AATCGCTACACTGGAGTCCCTGATCGCTTCA CTGGCAGTGGATATGGGACGGATTTCACTTT CACCATCAGCACTGTGCAGGCTGAAGACCTG GCAGTTTATTTCTGTCAGCAGGATTATAGCTC TCCGTGGACGTTCGGTGGAGGCACCAAGCTG GAAATCAAACGGGCTGATGCTGCACCAACTG TATCCATCTTCTCACCATCCAGTGAGCAGTTA ACATCTGGAGGTGCCTCAGTCGTGTGCTTCTT GAACAACTTCTACCCCAAAGACATCAATGTC AAGTGGAAGATTGATGGCAGTGAACGACAA AATGGCGTCCTGAACAGTTGGACTGATCAGG ACAGCAAAGACAGCACCTACAGCATGAGCA GCACCCTCACGTTGACCAAGGACGAGTATGA ACGACATAACAGCTATACCTGTGAGGCCACT CACAAGACATCAACTTCACCCATTGTCAAGA GCTTCAACAGGAATGAGTGT | 919 |
| SM1B109 | pDR000023 628 | GACATTGTGATGACCCAGTCTCCAGCTTCTTT GGCTGTGTCTCTAGGGCAGAGGGCCACCATC TCCTGCAGAGCCAGCGAAAGTGTTGATAATT CTGGCATTAGTTTTATGAACTGGTTCCAACAG AAACCAGGACAGCCACCCAAACTCCTCATCT ATGCTGCATCCAACCAAGGATCCGGGGTCCC TGCCAGGTTTAGTGGCAGTGGGTCTGGGACA GACTTCAGCCTCAACATCCATCCTATGGAGG AGGATGATACTGCAATGTATTTCTGTCAGCA AAGTAAGGAGGTTCCGTACACGTTCGGAGGG GGGACCAAGCTGGAAATAAAACGGGCTGAT GCTGCACCAACTGTATCCATCTTCCCACCATC CAGTGAGCAGTTAACATCTGGAGGTGCCTCA GTCGTGTGCTTCTTGAACAACTTCTACCCCAA AGACATCAATGTCAAGTGGAAGATTGATGGC AGTGAACGACAAAATGGCGTCCTGAACAGTT GGACTGATCAGGACAGCAAAGACAGCACCT ACAGCATGAGCAGCACCCTCACGTTGACCAA GGACGAGTATGAACGACATAACAGCTATACC TGTGAGGCCACTCACAAGACATCAACTTCAC CCATTGTCAAGAGCTTCAACAGGAATGAGTG T | 920 |
| SM1B110 | pDR000023 629 | GATATTGTGCTAACTCAGTCTCCAGCAATCAT GTCTGCATCTCCAGGGGAGAAGGTCACCATA ACCTGCAGTGCCAGCTCAAGTGTAAGTTACA TGCACTGGTTCCAGCAGAAGCCAGGCACTTC TCCCAAACTCTGGATTTATAGCACATCCAAC CTGGCTTCTGGAGTCCCTGCTCGCTTCAGTGG CAGTGGATCTGGGACCTCTTACTCTCTCACAA TCAGCCGAATGGAGGCTGAAGATGCTGCCAC | 921 |

TABLE 28-continued

LukAB Antibody Light Chain CDSs

| mAB/Fab name | Construct ID | Light Chain CDS | SEQ ID NO: |
|---|---|---|---|
|  |  | TTATTACTGCCAGCAAAGGAGTAGTTACCCA TTCACGTTCGGCTCGGGGACAAAGTTGGAAA TAAAACGGGCTGATGCTGCACCAACTGTATC CATCTTCCCACCATCCAGTGAGCAGTTAACA TCTGGAGGTGCCTCAGTCGTGTGCTTCTTGAA CAACTTCTACCCCAAAGACATCAATGTCAAG TGGAAGATTGATGGCAGTGAACGACAAAATG GCGTCCTGAACAGTTGGACTGATCAGGACAG CAAAGACAGCACCTACAGCATGAGCAGCACC CTCACGTTGACCAAGGACGAGTATGAACGAC ATAACAGCTATACCTGTGAGGCCACTCACAA GACATCAACTTCACCCATTGTCAAGAGCTTC AACAGGAATGAGTGT |  |
| SM1B111 | pDR000023631 | GACATTGTGATGACCCAGTCTCCAACCACCA TGGCTGCATCTCCCGGGGAGAGGATCACTAT CACCTGCAGTGCCCACTCAAATTTAATTTCCA ATTACTTACATTGGTATCAGCAGAAGCCAGG ATTCTCCCCTAAACTCTTGATTTATAGGACAT CCAATCTGGCTTCTGGAGTCCCAGCTCGCTTC AGTGGCAGTGGGTCTGGGACCTCTTACTCTCT CACAATTGGCACCATGGAGGCTGAAGATGTT GCCACTTACTTCTGCCAACAGGGTAGTAGTA TACCATTCACGTTCGGCTCGGGGACAAAGTT GGAAATAAAACGGGCTGATGCTGCACCAACT GTATCCATCTTCCCACCATCCAGTGAGCAGTT AACATCTGGAGGTGCCTCAGTCGTGTGCTTCT TGAACAACTTCTACCCCAAAGACATCAATGT CAAGTGGAAGATTGATGGCAGTGAACGACA AAATGGCGTCCTGAACAGTTGGACTGATCAG GACAGCAAAGACAGCACCTACAGCATGAGC AGCACCCTCACGTTGACCAAGGACGAGTATG AACGACATAACAGCTATACCTGTGAGGCCAC TCACAAGACATCAACTTCACCCATTGTCAAG AGCTTCAACAGGAATGAGTGT | 922 |
| SM1B112 | pDR000023630 | CAAATTGTTCTCACCCAGTCTCCAACAATCAT GTCTGCATCTCCAGGGGAAAAGGTCACCATG ACCTGCAGTGCCAGCTCACATGTAAGTTACA TATACTGGTACCAGCAGAAGCCAGGCTCCTC CCCCAGACTCTGGATTTATGACACATCCAAC CTGGTTTCTGGAGTCCCTGCTCGCTTCAGTGG CAGTAGGTCTGGGACCTCTTATTCTCTCACAA TCAGCAGCATGGAGGCTGAAGATGCTGCCAC TTATTACTGCCAGCAGTACAGTGGTTACCCGT ACACGTTCGGAGGGGGGACCAAGCTGGAAA TAAAACGGGCTGATGCTGCACCAACTGTATC CATCTTCCCACCATCCAGTGAGCAGTTAACA TCTGGAGGTGCCTCAGTCGTGTGCTTCTTGAA CAACTTCTACCCCAAAGACATCAATGTCAAG TGGAAGATTGATGGCAGTGAACGACAAAATG GCGTCCTGAACAGTTGGACTGATCAGGACAG CAAAGACAGCACCTACAGCATGAGCAGCACC CTCACGTTGACCAAGGACGAGTATGAACGAC ATAACAGCTATACCTGTGAGGCCACTCACAA GACATCAACTTCACCCATTGTCAAGAGCTTC AACAGGAATGAGTGT | 923 |
| SM1B243 | pDR000030110 | GACATCAAGATGACCCAGAGCCCCAGCTCTA TGTACGCCAGCCTGGGCGAGCGCGTGACCAT CACCTGTAAAGCCAGCCAGGACATCAACAGC TACCTGAGCTGGTTCCAGCAGAAGCCCGGCA AGAGCCCCAAGACCCTGATCTACCGGGCCAA CAGACTGGTGGACGGCGTGCCAAGCAGATTC AGCGGCTCTGGCAGCGGCCAGGACTACAGCC CTACCATCAGCAGCCTGGAATACGAGGACAT GGGCATCTACTACTGCCTGCAGTACGACGAG TTCCCCTACACCTTCGGCGGAGGCACCAAGC TGGAAATCAAGCGGGCTGATGCTGCACCGAC TGTGTCCATCTTCCCACCATCCAGTGAGCAGT TAACATCTGGAGGTGCCTCAGTCGTGTGCTTC TTGAACAACTTCTACCCCAAAGACATCAATG | 924 |

TABLE 28-continued

LukAB Antibody Light Chain CDSs

| mAB/ Fab name | Construct ID | Light Chain CDS | SEQ ID NO: |
| --- | --- | --- | --- |
| | | TCAAGTGGAAGATTGATGGCAGTGAACGACA AAATGGCGTCCTGAACAGTTGGACTGATCAG GACAGCAAAGACAGCACCTACAGCATGAGC AGCACCCTCACGTTGACCAAGGACGAGTATG AACGACATAACAGCTATACCTGTGAGGCCAC TCACAAGACATCAACTTCACCCATTGTCAAG AGCTTCAACAGGAATGAGTGT | |
| SM1B244 | pDR000030 235 | GACATCGTGATGACCCAGAGCCAGAAATTCA TGAGCACCAGCGTGGGCGACCGGGTGTCCGT GACATGCAAGGCCAGCCAGAACGTGGGCAC CAACGTGGCCTGGTATCAGCAGAAGCCCGGC CAGAGCCCCAAGACCCTGATCTACAGCGCCA GCTACAGATACAGCGGCGTGCCCGATAGCTT CACAGGCAGCGGCTCTGGCACCGACTTCACC CTGACCATCAGCAACGTGCAGAGCGAGGACT GGGCCGAGTACTTCTGCCAGCAGTACAACAG CTACCCCTTCACCTTCGGCAGCGGCACCAAG CTGGAAATCAAGCGGGCTGATGCTGCACCGA CTGTGTCCATCTTCCCACCATCCAGTGAGCAG TTAACATCTGGAGGTGCCTCAGTCGTGTGCTT CTTGAACAACTTCTACCCCAAAGACATCAAT GTCAAGTGGAAGATTGATGGCAGTGAACGAC AAAATGGCGTCCTGAACAGTTGGACTGATCA GGACAGCAAAGACAGCACCTACAGCATGAG CAGCACCCTCACGTTGACCAAGGACGAGTAT GAACGACATAACAGCTATACCTGTGAGGCCA CTCACAAGACATCAACTTCACCCATTGTCAA GAGCTTCAACAGGAATGAGTGT | 925 |
| SM1B245 | pDR000030 236 | GACATCGTGCTGACACAGTCTCCAGCCAGCC TGGCCGTGTCTCTGGGACAGAGGGCCACCAT GAGCTGCAGAGCCAGCGAGTCTGTGGACGGC TACGGCAACAGCTTCCTGCACTGGTATCAGC AGAAGCCCGGCCAGCCTCCCAAGCTGCTGAT CTACAGGGCCAGCAACCTGGAAAGCGGCATC CCCGCCAGATTCAGCGGCACCGGCAGCAGAA CCGACTTCACCCTGACCATCACCCCTGTGGA AGCCGACGACGTGGCCACCTACTACTGCCAG CAGAGCAACGGCGACCCCTTCACCTTCGGCT CCGGCACCAAGCTGGAAATCAAGCGGGCTGA TGCTGCACCGACTGTGTCCATCTTCCCACCAT CCAGTGAGCAGTTAACATCTGGAGGTGCCTC AGTCGTGTGCTTCTTGAACAACTTCTACCCCA AAGACATCAATGTCAAGTGGAAGATTGATGG CAGTGAACGACAAAATGGCGTCCTGAACAGT TGGACTGATCAGGACAGCAAAGACAGCACCT ACAGCATGAGCAGCACCCTCACGTTGACCAA GGACGAGTATGAACGACATAACAGCTATACC TGTGAGGCCACTCACAAGACATCAACTTCAC CCATTGTCAAGAGCTTCAACAGGAATGAGTG T | 926 |
| SM1B246 | pDR000030 237 | GACGTGCTGATGACCCAGACACCCCTGAGCC TGCCTGTGTCTCTGGGCGATCAGGCCAGCAT CAGCTGCCGGTCTAGCCAGAGCATCGTGCAC AGCAACGGCAAGACCTACCTGGAATGGTATC TGCAGAAGCCCGGCCAGAGCCCCAAGCTGCT GATCTACAAGGTGTCCAACAGATTCAGCGGC GTGCCCGACAGATTCTCTGGCAGCGGCTCTG GCACCGACTTCACCCTGAAGATCAGCCGGGT GGAAGCCGAGGACCTGGGCGTGTACTACTGT CTGCAGGGCAGCCACGTGCCCTGGACCTTTG GCGGCGGAACAAAGCTGGAACTGAAGCGGG CTGATGCTGCACCGACTGTGTCCATCTTCCCA CCATCCAGTGAGCAGTTAACATCTGGAGGTG CCTCAGTCGTGTGCTTCTTGAACAACTTCTAC CCCAAAGACATCAATGTCAAGTGGAAGATTG ATGGCAGTGAACGACAAAATGGCGTCCTGAA CAGTTGGACTGATCAGGACAGCAAAGACAGC ACCTACAGCATGAGCAGCACCCTCACGTTGA CCAAGGACGAGTATGAACGACATAACAGCTA | 927 |

TABLE 28-continued

LukAB Antibody Light Chain CDSs

| mAB/Fab name | Construct ID | Light Chain CDS | SEQ ID NO: |
|---|---|---|---|
| | | TACCTGTGAGGCCACTCACAAGACATCAACT TCACCCATTGTCAAGAGCTTCAACAGGAATG AGTGT | |
| SM1B247 | pDR000030 238 | GACATCGTGCTGACACAGTCTCCAGCCAGCC<br><br>TGGCCGTGTCTCTGGGACAGAGAGCCACCAT CAGCTGCCGGGCCAGCAAGAGCGTGTCCATC AGCGGCTACAGCTACATGCACTGGTATCAGC AGAAGCCCGGCCAGCCTCCCAAGCTGCTGAT CGACCTGGCCAGCAACCTGGAAAGCGGCGTG CCAGCCAGATTTTCTGGCAGCGGCTCCGGCA CCGACTTCACCCTGAACATCCACCCCGTGGA AGAAGAGGACGCCGCCACCTACTACTGCCAG CACAGCAGAGAGCTGCCCTTCACCTTCGGCA GCGGCACCAAGCTGGAAATCAAGCGGGCTG ATGCTGCACCGACTGTGTCCATCTTCCCACCA TCCAGTGAGCAGTTAACATCTGGAGGTGCCT CAGTCGTGTGCTTCTTGAACAACTTCTACCCC AAAGACATCAATGTCAAGTGGAAGATTGATG GCAGTGAACGACAAAATGGCGTCCTGAACAG TTGGACTGATCAGGACAGCAAAGACAGCACC TACAGCATGAGCAGCACCCTCACGTTGACCA AGGACGAGTATGAACGACATAACAGCTATAC CTGTGAGGCCACTCACAAGACATCAACTTCA CCCATTGTCAAGAGCTTCAACAGGAATGAGT GT | 928 |
| SM1B248 | pDR000030 236 | GACATCGTGCTGACACAGTCTCCAGCCAGCC<br><br>TGGCCGTGTCTCTGGGACAGAGGGCCACCAT GAGCTGCAGAGCCAGCGAGTCTGTGGACGGC TACGGCAACAGCTTCCTGCACTGGTATCAGC AGAAGCCCGGCCAGCCTCCCAAGCTGCTGAT CTACAGGGCCAGCAACCTGGAAAGCGGCATC CCCGCCAGATTCAGCGGCACCGGCAGCAGAA CCGACTTCACCCTGACCATCACCCCTGTGGA AGCCGACGACGTGGCCACCTACTACTGCCAG CAGAGCAACGGCGACCCCTTCACCTTCGGCT CCGGCACCAAGCTGGAAATCAAGCGGGCTGA TGCTGCACCGACTGTGTCCATCTTCCCACCAT CCAGTGAGCAGTTAACATCTGGAGGTGCCTC AGTCGTGTGCTTCTTGAACAACTTCTACCCCA AAGACATCAATGTCAAGTGGAAGATTGATGG CAGTGAACGACAAAATGGCGTCCTGAACAGT TGGACTGATCAGGACAGCAAAGACAGCACCT ACAGCATGAGCAGCACCCTCACGTTGACCAA GGACGAGTATGAACGACATAACAGCTATACC TGTGAGGCCACTCACAAGACATCAACTTCAC CCATTGTCAAGAGCTTCAACAGGAATGAGTG T | 929 |
| SM1B249 | pDR000030 239 | CAGATCGTGCTGACCCAGAGCCCTGCCATCA<br><br>TGTCTGCCAGCCCTGGCGAGAAAGTGACCAT GACCTGTAGCGCCAGCAGCAGCGTGTCCTAC ATGCACTGGTATCAGCAGAAGTCCGGCACCA GCCCCAAGCGGTGGATCTACGATACCAGCAA GCTGGCCTCCGGCGTGCCAGCCAGATTTTCT GGCTCTGGCAGCGGCACCTCCTACAGCCTGA CCATCAGCAGCATGGAAGCCGAGGACGCCGC CACCTACTACTGCCAGCAGTGGATCAGCAAC CCTCCCACCTTCGGCGGAGGCACCAAGCTGG AAATCAAGCGGGCTGATGCTGCACCGACTGT GTCCATCTTCCCACCATCCAGTGAGCAGTTA ACATCTGGAGGTGCCTCAGTCGTGTGCTTCTT GAACAACTTCTACCCCAAAGACATCAATGTC AAGTGGAAGATTGATGGCAGTGAACGACAA AATGGCGTCCTGAACAGTTGGACTGATCAGG ACAGCAAAGACAGCACCTACAGCATGAGCA GCACCCTCACGTTGACCAAGGACGAGTATGA ACGACATAACAGCTATACCTGTGAGGCCACT CACAAGACATCAACTTCACCCATTGTCAAGA GCTTCAACAGGAATGAGTGT | 930 |

TABLE 28-continued

LukAB Antibody Light Chain CDSs

| mAB/Fab name | Construct ID | Light Chain CDS | SEQ ID NO: |
|---|---|---|---|
| 5M1B250 | pDR000030240 | GACATCGTGCTGACACAGTCTCCAGCCAGCCTGGCCGTGTCCCTGGAACAGAGAGCCACCATCAGCTGCAAGGCCAGCCAGAGCGTGGACTACGACGGCGACAGCTACATGAACTGGTATCAGCAGAAGCCCGGCCAGCCTCCCAAGCTGCTGATCTACGCCGCCAGCAACCTGGAAAGCGGCATCCCTGCCAGATTCAGCGGCAGCGGCTCTGGCACCGACTTCACCCTGAACATCCACCCCGTGGAAGAAGAGGACGCCGCCACCTACTACTGCCAGCAGAGCAACGAGGACCCTCTGACCTTCGGAGCCGGCACCAAGCTGGAACTGAAGCGGGCTGATGCTGCACCGACTGTGTCCATCTTCCCACCATCCAGTGAGCAGTTAACATCTGGAGGTGCCTCAGTCGTGTGCTTCTTGAACAACTTCTACCCCAAAGACATCAATGTCAAGTGGAAGATTGATGGCAGTGAACGACAAAATGGCGTCCTGAACAGTTGGACTGATCAGGACAGCAAAGACAGCACCTACAGCATGAGCAGCACCCTCACGTTGACCAAGGACGAGTATGAACGACATAACAGCTATACCTGTGAGGCCACTCACAAGACATCAACTTCACCCATTGTCAAGAGCTTCAACAGGAATGAGTGT | 931 |
| SM1B251 | pDR000030241 | GACATCCAGATGACCCAGAGCCCTGCCAGCCTGAGCGCCTCTGTGGGCGAGACAGTGACCACCATCTGCCGGGCCAGCGAGAACATCTACAGCTACCTGGCCTGGTATCAGCAGAAGCAGGGCAAGAGCCCTCAGCTGCTGGTGTACAACGCCAAGACCCTGGTGGAAGGCGTGCCCAGCAGATTTTCTGGCTCTGGCAGCGGCACCGAGTTCAGCCTGAAGATCAACAGCCTGCAGCCCGAGGACTTCGGCAGCTACTACTGCCAGCACCACTACGGCAGCCCCTACACCTTTGGCGGAGGCACCAAGCTGGAACTGAAGCGGGCTGATGCTGCACCGACTGTGTCCATCTTCCCACCATCCAGTGAGCAGTTAACATCTGGAGGTGCCTCAGTCGTGTGCTTCTTGAACAACTTCTACCCCAAAGACATCAATGTCAAGTGGAAGATTGATGGCAGTGAACGACAAAATGGCGTCCTGAACAGTTGGACTGATCAGGACAGCAAAGACAGCACCTACAGCATGAGCAGCACCCTCACGTTGACCAAGGACGAGTATGAACGACATAACAGCTATACCTGTGAGGCCACTCACAAGACATCAACTTCACCCATTGTCAAGAGCTTCAACAGGAATGAGTGT | 932 |
| SM1B252 | pDR000030242 | GACGTGCTGATGACCCAGACACCCCTGAGCCTGCCTGTGTCTCTGGGCGATCAGGCCAGCATCAGCTGCCGGTCTAGCCAGAGCATCGTGTACAGCAACGGCAACACCTACCTGGAATGGTATCTGCAGAAGCCCGGCCAGAGCCCCAAGCTGCTGATCTACAAGGTGTCCAACAGATTCAGCGGCGTGCCCGACAGATTCTCTGGCAGCGGCTCTGGCACCGACTTCACCCTGAAGATCAGCCGGGTGGAAGCCGAGGACCTGGGCGTGTACTACTGTTTTCAGGGCAGCCACGTGCCCTTCACCTTCGGCAGCGGCACCAAGCTGGAAATCAAGCGGGCTGATGCTGCACCGACTGTGTCCATCTTCCCACCATCCAGTGAGCAGTTAACATCTGGAGGTGCCTCAGTCGTGTGCTTCTTGAACAACTTCTACCCCAAAGACATCAATGTCAAGTGGAAGATTGATGGCAGTGAACGACAAAATGGCGTCCTGAACAGTTGGACTGATCAGGACAGCAAAGACAGCACCTACAGCATGAGCAGCACCCTCACGTTGACCAAGGACGAGTATGAACGACATAACAGCTATACCTGTGAGGCCACTCACAAGACATCAACTTCACCCATTGTCAAGAGCTTCAACAGGAATGAGTGT | 933 |
| 5M1B253 | pDR000030243 | GACGTCGTGATGACCCAGACCCCTCTGACCCTGAGCGTGACAATCGGCCAGGCCGCCAGCATCAGCTGCAAGAGCAGCCAGAGCCTGCTGCAC | 934 |

TABLE 28-continued

LukAB Antibody Light Chain CDSs

| mAB/ Fab name | Construct ID | Light Chain CDS | SEQ ID NO: |
|---|---|---|---|
| | | AGCGACGGCAAGACCTACCTGAACTGGCTGC TGCAGAGGCCTGGCCAGAGCCCCAAGAGACT GATCTACCTGGTGTCCAAGCTGGACAGCGGC GTGCCCGATAGATTCACAGGCAGCGGCTCCG GCACCGACTTCACCCTGAAGATCAGCCGGGT GGAAGCCGAGGACCTGGGCGTGTACTACTGC TGGCAGGGCACCCACTTCCCTTACACCTTCG GCGGAGGCACAAAGCTGGAAATCAAGCGGG CTGATGCTGCACCGACTGTGTCCATCTTCCCA CCATCCAGTGAGCAGTTAACATCTGGAGGTG CCTCAGTCGTGTGCTTCTTGAACAACTTCTAC CCCAAAGACATCAATGTCAAGTGGAAGATTG ATGGCAGTGAACGACAAAATGGCGTCCTGAA CAGTTGGACTGATCAGGACAGCAAAGACAGC ACCTACAGCATGAGCAGCACCCTCACGTTGA CCAAGGACGAGTATGAACGACATAACAGCTA TACCTGTGAGGCCACTCACAAGACATCAACT TCACCCATTGTCAAGAGCTTCAACAGGAATG AGTGT | |
| 5M1B254 | pDR000030 244 | GACGTCGTGATGACCCAGACCCCTCTGACCC TGAGCGTGACAGTGGGCCAGCCTGCCAGCAT CAGCTGCAAGAGCAGCCAGAGCCTGCTGCAC AGCGACGGCAAGACCTACCTGAACTGGCTGC TGCAGAGGCCTGGCCAGAGCCCCAAGAGACT GATCTACCTGGTGTCCAAGCTGGACAGCGGC GTGCCCGATAGATTCACAGGCAGCGGCTCCG GCACCGACTTCACCCTGAAGATCAGCCGGGT GGAAGCCGAGGACCTGGGCGTGTACTACTGT TGGCAGGGCACCCACTTCCCTTACACCTTCG GCGGAGGCACAAAGCTGGAAATCAAGCGGG CTGATGCTGCACCGACTGTGTCCATCTTCCCA CCATCCAGTGAGCAGTTAACATCTGGAGGTG CCTCAGTCGTGTGCTTCTTGAACAACTTCTAC CCCAAAGACATCAATGTCAAGTGGAAGATTG ATGGCAGTGAACGACAAAATGGCGTCCTGAA CAGTTGGACTGATCAGGACAGCAAAGACAGC ACCTACAGCATGAGCAGCACCCTCACGTTGA CCAAGGACGAGTATGAACGACATAACAGCTA TACCTGTGAGGCCACTCACAAGACATCAACT TCACCCATTGTCAAGAGCTTCAACAGGAATG AGTGT | 935 |
| 5M1B255 | pDR000030 245 | GACGTCGTGATGACCCAGACCCCTCTGACCC TGAGCGTGACAATCGGCCAGCCTGCCAGCAT CAGCTGCAAGAGCAGCCAGAGCCTGCTGGAC AGCGACGGCGAGACATACCTGAACTGGCTGC TGCAGAGGCCTGGCCAGAGCCCCAAGCGGCT GATCTACATGGTGTCCAAGCTGGACTCCGGC GTGCCCGACAGATTCACAGGCAGCGGCAGCG GAACCGACTTCACCCTGAAGATCAGCAGAGT GGAAGCCGAGGACCTGGGCGTGTACTACTGT TGGCAGGGCACCCACTTCCCTCAGACCTTCG GCGGAGGCACAAAGCTGGAACTGAAGCGGG CTGATGCTGCACCGACTGTGTCCATCTTCCCA CCATCCAGTGAGCAGTTAACATCTGGAGGTG CCTCAGTCGTGTGCTTCTTGAACAACTTCTAC CCCAAAGACATCAATGTCAAGTGGAAGATTG ATGGCAGTGAACGACAAAATGGCGTCCTGAA CAGTTGGACTGATCAGGACAGCAAAGACAGC ACCTACAGCATGAGCAGCACCCTCACGTTGA CCAAGGACGAGTATGAACGACATAACAGCTA TACCTGTGAGGCCACTCACAAGACATCAACT TCACCCATTGTCAAGAGCTTCAACAGGAATG AGTGT | 936 |
| 5M1B256 | pDR000030 246 | GACGTCGTGATGACCCAGACCCCTCTGACCC TGAGCGTGACCAATGGCCAGCCTGCCAGCAT CAGCTGCAAGAGCAGCCAGAGCCTGCTGGAC AGCGACGGCGAGACATACCTGAACTGGCTGC TGCAGAGGCCTGGCCAGAGCCCCAAGAGACT GATCTACCTGGTGTCCAAGCTGGACTCCGGC | 937 |

TABLE 28-continued

LukAB Antibody Light Chain CDSs

| mAB/ Fab name | Construct ID | Light Chain CDS | SEQ ID NO: |
|---|---|---|---|
| | | GTGCCCGACAGATTCATCGGCTCTGGCAGCG GCACCGACTTCACCCTGAAGATCAGCCGGGT GGAAGCCGAGGACCTGGGCGTGTACTTCTGT TGGCAGGGCACCCACAGCCCCTACACCTTTG GCGGCGGAACAAAGCTGGAAATCAAGCGGG CTGATGCTGCACCGACTGTGTCCATCTTCCCA CCATCCAGTGAGCAGTTAACATCTGGAGGTG CCTCAGTCGTGTGCTTCTTGAACAACTTCTAC CCCAAAGACATCAATGTCAAGTGGAAGATTG ATGGCAGTGAACGACAAAATGGCGTCCTGAA CAGTTGGACTGATCAGGACAGCAAAGACAGC ACCTACAGCATGAGCAGCACCCTCACGTTGA CCAAGGACGAGTATGAACGACATAACAGCTA TACCTGTGAGGCCACTCACAAGACATCAACT TCACCCATTGTCAAGAGCTTCAACAGGAATG AGTGT | |
| SM1B257 | pDR000030 247 | GACATCCAGATGACCCAGAGCCCTAGCAGCC TGTCTGCCAGCCTGGGCGGCAAAGTGACCAT CACATGCAAGGCCAGCCAGGACATCAACAA GTATATCGCCTGGTATCAGCACAAGCCCGGC AAGGGCCCCAGACTGCTGATCCACTACACCA GCACCCTGCAGCCCGGCATCCCTAGCAGATT TTCTGGCAGCGGCTCCGGCAGAGACTACAGC TTCAGCATCAGCAACCTGGAACCCGAGGATA TCGCCACCTACTACTGCCTGCAGTACGACAA CCTGCGGACCTTCGGCGGAGGCACCAAGGTG GAAATCAAGCGGGCTGATGCTGCACCGACTG TGTCCATCTTCCCACCATCCAGTGAGCAGTTA ACATCTGGAGGTGCCTCAGTCGTGTGCTTCTT GAACAACTTCTACCCCAAAGACATCAATGTC AAGTGGAAGATTGATGGCAGTGAACGACAA AATGGCGTCCTGAACAGTTGGACTGATCAGG ACAGCAAAGACAGCACCTACAGCATGAGCA GCACCCTCACGTTGACCAAGGACGAGTATGA ACGACATAACAGCTATACCTGTGAGGCCACT CACAAGACATCAACTTCACCCATTGTCAAGA GCTTCAACAGGAATGAGTGT | 938 |
| SM1B258 | pDR000030 248 | GACGTGCTGATGACCCAGACACCCCTGAGCC TGCCTGTGTCTCTGGGCGATCAGGCCAGCAT CAGCTGCCGGTCTAGCCAGAGCATCGTGCAC AGCAACGGCAACACCTACCTGGAATGGTATC TGCAGAAGCCCGGCCAGAGCCCCAAGCTGCT GATCTACAAGGTGTCCAACAGATTCAGCGGC GTGCCCGACAGATTCTCTGGCAGCGGCTCTG GCACCGACTTCACCCTGAAGATCAGCCGGGT GGAAGCCGAGGACCTGGGCGTGTACTACTGT TTTCAGGGCAGCCACGTGCCCTTCACCTTCGG CAGCGGCACCAAGCTGGAAATCAAGCGGGCT GATGCTGCACCGACTGTGTCCATCTTCCCACC ATCCAGTGAGCAGTTAACATCTGGAGGTGCC TCAGTCGTGTGCTTCTTGAACAACTTCTACCC CAAAGACATCAATGTCAAGTGGAAGATTGAT GGCAGTGAACGACAAAATGGCGTCCTGAACA GTTGGACTGATCAGGACAGCAAAGACAGCAC CTACAGCATGAGCAGCACCCTCACGTTGACC AAGGACGAGTATGAACGACATAACAGCTATA CCTGTGAGGCCACTCACAAGACATCAACTTC ACCCATTGTCAAGAGCTTCAACAGGAATGAG TGT | 939 |
| SM1B259 | pDR000030 249 | CAGATCGTGCTGACCCAGAGCCCTGCCATCA TGTCTGCCAGCCCTGGCGAGAAAGTGACCAT GACCTGTAGCGCCAGCAGCAGCGTGTCCTAC ATGTACTGGTATCAGCAGAAGCCCGGCAGCA GCCCCAGACTGCTGATCTACGACACCAGCAA CCTGGCCAGCGGCGTGCCAGTGCGGTTTTCT GGCAGCGGCAGCGGAACCAGCTACAGCCTG ACCATCAGCCCGGATGGAAGCCGAGGACGCC GCCACCTACTACTGCCAGCAGTGGTCCAGCT ACCCCTCCCACCTTTGGCGGAGGCACCAAGCT | 940 |

TABLE 28-continued

LukAB Antibody Light Chain CDSs

| mAB/ Fab name | Construct ID | Light Chain CDS | SEQ ID NO: |
|---|---|---|---|
| | | GGAAATCAAGCGGGCTGATGCTGCACCGACT GTGTCCATCTTCCCACCATCCAGTGAGCAGTT AACATCTGGAGGTGCCTCAGTCGTGTGCTTCT TGAACAACTTCTACCCCAAAGACATCAATGT CAAGTGGAAGATTGATGGCAGTGAACGACA AAATGGCGTCCTGAACAGTTGGACTGATCAG GACAGCAAAGACAGCACCTACAGCATGAGC AGCACCCTCACGTTGACCAAGGACGAGTATG AACGACATAACAGCTATACCTGTGAGGCCAC TCACAAGACATCAACTTCACCCATTGTCAAG AGCTTCAACAGGAATGAGTGT | |
| SM1B260 | pDR000030 236 | GACATCGTGCTGACACAGTCTCCAGCCAGCC TGGCCGTGTCTCTGGGACAGAGGGCCACCAT GAGCTGCAGAGCCAGCGAGTCTGTGGACGGC TACGGCAACAGCTTCCTGCACTGGTATCAGC AGAAGCCCGGCCAGCCTCCCAAGCTGCTGAT CTACAGGGCCAGCAACCTGGAAAGCGGCATC CCCGCCAGATTCAGCGGCACCGGCAGCAGAA CCGACTTCACCCTGACCATCACCCCTGTGGA AGCCGACGACGTGGCCACCTACTACTGCCAG CAGAGCAACGGCGACCCCTTCACCTTCGGCT CCGGCACCAAGCTGGAAATCAAGCGGGCTGA TGCTGCACCGACTGTGTCCATCTTCCCACCAT CCAGTGAGCAGTTAACATCTGGAGGTGCCTC AGTCGTGTGCTTCTTGAACAACTTCTACCCCA AAGACATCAATGTCAAGTGGAAGATTGATGG CAGTGAACGACAAAATGGCGTCCTGAACAGT TGGACTGATCAGGACAGCAAAGACAGCACCT ACAGCATGAGCAGCACCCTCACGTTGACCAA GGACGAGTATGAACGACATAACAGCTATACC TGTGAGGCCACTCACAAGACATCAACTTCAC CCATTGTCAAGAGCTTCAACAGGAATGAGTG T | 941 |
| SM1B261 | pDR000030 250 | AACATCGTGATGACCCAGAGCCCCAAGAGCA TGAGCATGTCCGTGGGCGAGAGAGTGACCCT GAGCTGCAAGGCCAGCGAGAACGTGGGCAC CTACGTGTCCTGGTATCAGCAGAAGCCCGAG CAGAGCCCTAAGCTGCTGATCTACGGGGCCA GCAACAGATACACCGGCGTGCCCGAGAGATT CACAGGCAGCGGCAGCGCCACCGACTTCACC CTGACAATCAGCAGCGTGCAGGCCGAGGACC TGGCCGATTACCACTGTGGCCAGAGCTACAG CTACCCTCTGACCTTCGGAGCCGGCACCAAG CTGGAACTGAAGCGGGCTGATGCTGCACCGA CTGTGTCCATCTTCCCACCATCCAGTGAGCAG TTAACATCTGGAGGTGCCTCAGTCGTGTGCTT CTTGAACAACTTCTACCCCAAAGACATCAAT GTCAAGTGGAAGATTGATGGCAGTGAACGAC AAAATGGCGTCCTGAACAGTTGGACTGATCA GGACAGCAAAGACAGCACCTACAGCATGAG CAGCACCCTCACGTTGACCAAGGACGAGTAT GAACGACATAACAGCTATACCTGTGAGGCCA CTCACAAGACATCAACTTCACCCATTGTCAA GAGCTTCAACAGGAATGAGTGT | 942 |
| SM1B262 | pDR000030 251 | GACATCAAGATGACCCAGAGCCCCAGCTCTA TGTACGCCAGCCTGGGCGAGCGCGTGACCAT CACCTGTAAAGCCAGCCAGGACATCAACAGC TACCTGAGCTGGTTCCAGCAGAAGCCCGGCA AGAGCCCCAAGACCCTGATCTACCGGGCCAA CAGACTGGTGGACGGCGTGCCAAGCAGATTC AGCGGCTCTGGCAGCGGCCAGGACTACAGCC TGACCATCAGCAGCCTGGAATACGAGGACAT GGGCATCTACTACTGCCTGCAGTACGACGAG TTCCCTCTGACCTTCGGAGCCGGCACCAAGC TGGAACTGAAGCGGGCTGATGCTGCACCGAC TGTGTCCATCTTCCCACCATCCAGTGAGCAGT TAACATCTGGAGGTGCCTCAGTCGTGTGCTTC TTGAACAACTTCTACCCCAAAGACATCAATG TCAAGTGGAAGATTGATGGCAGTGAACGACA | 943 |

TABLE 28-continued

LukAB Antibody Light Chain CDSs

| mAB/ Fab name | Construct ID | Light Chain CDS | SEQ ID NO: |
|---|---|---|---|
| | | AAATGGCGTCCTGAACAGTTGGACTGATCAG GACAGCAAAGACAGCACCTACAGCATGAGC AGCACCCTCACGTTGACCAAGGACGAGTATG AACGACATAACAGCTATACCTGTGAGGCCAC TCACAAGACATCAACTTCACCCATTGTCAAG AGCTTCAACAGGAATGAGTGT | |
| SM1B263 | pDR000030 252 | GACATCCAGATGACCCAGAGCCCTAGCAGCC TGTCTGCCAGCCTGGGCGGCAAAGTGACCAT CACATGCAAGGCCAGCCAGGACATCAACAA GTATATCGCCTGGTATCAGCACAAGCCCGGC AAGGGCCCCAGACTGCTGATCCACTACACCA GCACCCTGCAGCCCGGCATCCCTAGCAGATT TTCTGGCAGCGGCTCCGGCAGAGACTACAGC TTCAGCATCAGCAACCTGGAACCCGAGGATA TCGCCACCTACTACTGCCTGCAGTACGACAA CCTGTGGACCTTCGGCGGAGGCACCAAGGTG GAAATCAAGCGGGCTGATGCTGCACCGACTG TGTCCATCTTCCCACCATCCAGTGAGCAGTTA ACATCTGGAGGTGCCTCAGTCGTGTGCTTCTT GAACAACTTCTACCCCAAAGACATCAATGTC AAGTGGAAGATTGATGGCAGTGAACGACAA AATGGCGTCCTGAACAGTTGGACTGATCAGG ACAGCAAAGACAGCACCTACAGCATGAGCA GCACCCTCACGTTGACCAAGGACGAGTATGA ACGACATAACAGCTATACCTGTGAGGCCACT CACAAGACATCAACTTCACCCATTGTCAAGA GCTTCAACAGGAATGAGTGT | 944 |
| SM1B264 | pDR000030 253 | GACATCCAGATGACCCAGAGCCCTGCCAGCC TGAGCGCCTCTGTGGGCGAGACAGTGACCAT CATCTGCCGGGCCAGCGAGAACATCTACAGC AACCTGGCCTGGTATCAGCAGAAGCAGGGCA AGAGCCCTCAGCTGCTGGTGTACGCCGCCAC CAATCTGGCCGACGGCATGCCTAGCAGATTC AGCGGCTCTGGCAGCGGCACCCAGTACAGCC TGAAGATCAACAGCCTGCAGAGCGAGGACTT CGGCAGCTACTACTGCCAGCACTTCTGGGGC ACCCCTTGGACCTTTGGCGGAGGCACCAAGC TGGAAATCAAGCGGGCTGATGCTGCACCGAC TGTGTCCATCTTCCCACCATCCAGTGAGCAGT TAACATCTGGAGGTGCCTCAGTCGTGTGCTTC TTGAACAACTTCTACCCCAAAGACATCAATG TCAAGTGGAAGATTGATGGCAGTGAACGACA AAATGGCGTCCTGAACAGTTGGACTGATCAG GACAGCAAAGACAGCACCTACAGCATGAGC AGCACCCTCACGTTGACCAAGGACGAGTATG AACGACATAACAGCTATACCTGTGAGGCCAC TCACAAGACATCAACTTCACCCATTGTCAAG AGCTTCAACAGGAATGAGTGT | 945 |
| SM1B265 | pDR000030 254 | GACATCCAGATGACCCAGAGCCCTGCCAGCC TGAGCGCCTCTGTGGGCGAGACAGTGACCAT CATCTGCCGGGCCAGCGAGAACATCTACAGC TACCTGGCCTGGTATCAGCAGAAGCAGGGCA AGAGCCCTCAGCTGCTGTTCTACAACGCCAA GACCCTGGTGGAAGGCGTGCCCAGCAGATTT TCTGGCTCTGGCAGCGGCACCCAGTTCAGCC TGAAGATCAACAGCCTGCAGCCCGAGGACTT CGGCAGCTACTACTGCCAGCACCACTACGGC AGCCCCTACACCTTTGGCGGAGGCACCAAGC TGGAACTGAAGCGGGCTGATGCTGCACCGAC TGTGTCCATCTTCCCACCATCCAGTGAGCAGT TAACATCTGGAGGTGCCTCAGTCGTGTGCTTC TTGAACAACTTCTACCCCAAAGACATCAATG TCAAGTGGAAGATTGATGGCAGTGAACGACA AAATGGCGTCCTGAACAGTTGGACTGATCAG GACAGCAAAGACAGCACCTACAGCATGAGC AGCACCCTCACGTTGACCAAGGACGAGTATG AACGACATAACAGCTATACCTGTGAGGCCAC TCACAAGACATCAACTTCACCCATTGTCAAG AGCTTCAACAGGAATGAGTGT | 946 |

TABLE 28-continued

LukAB Antibody Light Chain CDSs

| mAB/Fab name | Construct ID | Light Chain CDS | SEQ ID NO: |
|---|---|---|---|
| SM1B266 | pDR000030255 | GACATCCAGATGACCCAGAGCCCTAGCACAC TGAGCGCCAGCCTGGGCGACACCATCACCAT CACATGCCACGCCAGCCAGAACATCAACGTG TGGCTGAGCTGGTATCAGCAGAAGCCCGGCA ACATCCCCAAGCTGCTGATCTACAAGGCCAG CAACCTGCACACCGGCGTGCCCAGCAGATTT TCTGGCAGCGGCTCTGGCACCGGCTTCACCC TGACAATCAGCAGCCTGCAGCCCGAGGATAT CGCCACCTACTACTGCCAGCAGGGCCAGAGC TACCCTCTGACCTTTGGCGCTGGCACCAAGG TGGAAATCAAGCGGGCTGATGCTGCACCGAC TGTGTCCATCTTCCCACCATCCAGTGAGCAGT TAACATCTGGAGGTGCCTCAGTCGTGTGCTTC TTGAACAACTTCTACCCCAAAGACATCAATG TCAAGTGGAAGATTGATGGCAGTGAACGACA AAATGGCGTCCTGAACAGTTGGACTGATCAG GACAGCAAAGACAGCACCTACAGCATGAGC AGCACCCTCACGTTGACCAAGGACGAGTATG AACGACATAACAGCTATACCTGTGAGGCCAC TCACAAGACATCAACTTCACCCATTGTCAAG AGCTTCAACAGGAATGAGTGT | 947 |
| SM1B267 | pDR000030256 | GACATCCAGATGACCCAGAGCCCTAGCACAC TGAGCGCCAGCCTGGGCGACACCATCACCAT CACATGCCACGCCAGCCAGAACATCAACGTG TGGCTGAGCTGGTATCAGCAGAAGCCCGGCA ACATCCCCAAGCTGCTGATCTACAAGGCCAG CAACCTGCACACCGGCGTGCCCAGCAGATTT TCTGGCAGCGGCTCTGGCACCGGCTTCACCC TGACAATCAGCAGCCTGCAGCCCGAGGATAT CGCCACCTACTACTGCCAGCAGGGCCAGAGC TACCCCTACACCTTTGGCGGAGGCACCAAGC TGGAAATCAAGCGGGCTGATGCTGCACCGAC TGTGTCCATCTTCCCACCATCCAGTGAGCAGT TAACATCTGGAGGTGCCTCAGTCGTGTGCTTC TTGAACAACTTCTACCCCAAAGACATCAATG TCAAGTGGAAGATTGATGGCAGTGAACGACA AAATGGCGTCCTGAACAGTTGGACTGATCAG GACAGCAAAGACAGCACCTACAGCATGAGC AGCACCCTCACGTTGACCAAGGACGAGTATG AACGACATAACAGCTATACCTGTGAGGCCAC TCACAAGACATCAACTTCACCCATTGTCAAG AGCTTCAACAGGAATGAGTGT | 948 |
| SM1B268 | pDR000030257 | GAGATCGTGCTGACCCAGAGCCCTACCACAA TGGCCGCCAGCCCTGGCGAGAAGATCACCAT CACATGCAGCGCCAGCAGCAGCATCAGCAGC AACTACCTGCACTGGTATCAGCAGAAGCCCG GCTTCAGCCCCAAGCTGCTGATCTACAGAAC CAGCAACCTGGCCAGCGGCGTGCCAGCCAGA TTTTCTGGCAGCGGCTCTGGCACCAGCTACA GCCTGACCATCGGCACCATGGAAGCCGAGGA CGTGGCCACCTACTACTGCCAGCAGGGCAGC TCCATCCCCAGAACCTTTGGCGGAGGCACCA AGCTGGAAATCAAGCGGGCTGATGCTGCACC GACTGTGTCCATCTTCCCACCATCCAGTGAGC AGTTAACATCTGGAGGTGCCTCAGTCGTGTG CTTCTTGAACAACTTCTACCCCAAAGACATC AATGTCAAGTGGAAGATTGATGGCAGTGAAC GACAAAATGGCGTCCTGAACAGTTGGACTGA TCAGGACAGCAAAGACAGCACCTACAGCATG AGCAGCACCCTCACGTTGACCAAGGACGAGT ATGAACGACATAACAGCTATACCTGTGAGGC CACTCACAAGACATCAACTTCACCCATTGTC AAGAGCTTCAACAGGAATGAGTGT | 949 |
| SM1B269 | pDR000030258 | GACATCGTGCTGACACAGTCTCCAGCCAGCC TGGCCGTGTCTCTGGGACAGAGAGCCACCAT CAGCTGCAAGGCCAGCCAGAGCGTGGACTAC GACGGCGACAGCTACATGAACTGGTATCAGC | 950 |

TABLE 28-continued

LukAB Antibody Light Chain CDSs

| mAB/ Fab name | Construct ID | Light Chain CDS | SEQ ID NO: |
|---|---|---|---|
| | | AGAAGCCCGGCCAGCCTCCCAAGCTGCTGAT CTACGCCGCCAGCAACCTGGAAAGCGGCATC CCTGCCAGATTCAGCGGCAGCGGCTCTGGCA CCGACTTCACCCTGAACATCCACCCCGTGGA AGAAGAGGACGCCGCCACCTACTACTGCCAG CAGAGCAACGAGGACCCCTACACCTTCGGCG GAGGCACCAAGCTGGAAATCAAGCGGGCTG ATGCTGCACCGACTGTGTCCATCTTCCCACCA TCCAGTGAGCAGTTAACATCTGGAGGTGCCT CAGTCGTGTGCTTCTTGAACAACTTCTACCCC AAAGACATCAATGTCAAGTGGAAGATTGATG GCAGTGAACGACAAAATGGCGTCCTGAACAG TTGGACTGATCAGGACAGCAAAGACAGCACC TACAGCATGAGCAGCACCCTCACGTTGACCA AGGACGAGTATGAACGACATAACAGCTATAC CTGTGAGGCCACTCACAAGACATCAACTTCA CCCATTGTCAAGAGCTTCAACAGGAATGAGT GT | |
| SM1B270 | pDR000030 259 | GACATCGTGCTGACACAGTCTCCAGCCAGCC TGGCCGTGTCTCTGGGACAGAGAGCCAGCAT CAGCTGCAAGGCCAGCCAGAGCGTGGACTAC GACGGCGACAGCTACATGAACTGGTATCAGC AGAAGCCCGGCCAGCCTCCCAAGCTGCTGAT CTACGCCGCCAGCAACCTGGAAAGCGGCATC CCTGCCAGATTCAGCGGCAGCGGCTCTGGCA CCGACTTCACCCTGAACATCCACCCCGTGGA AGAAGAGGACGCCGCCACCTACTACTGCCAG CAGAGCTACGAGGACCCCTTCACCTTCGGCT CCGGCACCAAGCTGGAAATCAAGCGGGCTGA TGCTGCACCGACTGTGTCCATCTTCCCACCAT CCAGTGAGCAGTTAACATCTGGAGGTGCCTC AGTCGTGTGCTTCTTGAACAACTTCTACCCCA AAGACATCAATGTCAAGTGGAAGATTGATGG CAGTGAACGACAAAATGGCGTCCTGAACAGT TGGACTGATCAGGACAGCAAAGACAGCACCT ACAGCATGAGCAGCACCCTCACGTTGACCAA GGACGAGTATGAACGACATAACAGCTATACC TGTGAGGCCACTCACAAGACATCAACTTCAC CCATTGTCAAGAGCTTCAACAGGAATGAGTG T | 951 |
| SM1B271 | pDR000030 249 | CAGATCGTGCTGACCCAGAGCCCTGCCATCA TGTCTGCCAGCCCTGGCGAGAAAGTGACCAT GACCTGTAGCGCCAGCAGCAGCGTGTCCTAC ATGTACTGGTATCAGCAGAAGCCCGGCAGCA GCCCCAGACTGCTGATCTACGACACCAGCAA CCTGGCCAGCGGCGTGCCAGTGCGGTTTTCT GGCAGCGGCAGCGGAACCAGCTACAGCCTG ACCATCAGCCGGATGGAAGCCGAGGACGCC GCCACCTACTACTGCCAGCAGTGGTCCAGCT ACCCTCCCACCTTTGGCGGAGGCACCAAGCT GGAAATCAAGCGGGCTGATGCTGCACCGACT GTGTCCATCTTCCCACCATCCAGTGAGCAGTT AACATCTGGAGGTGCCTCAGTCGTGTGCTTCT TGAACAACTTCTACCCCAAAGACATCAATGT CAAGTGGAAGATTGATGGCAGTGAACGACA AAATGGCGTCCTGAACAGTTGGACTGATCAG GACAGCAAAGACAGCACCTACAGCATGAGC AGCACCCTCACGTTGACCAAGGACGAGTATG AACGACATAACAGCTATACCTGTGAGGCCAC TCACAAGACATCAACTTCACCCATTGTCAAG AGCTTCAACAGGAATGAGTGT | 952 |
| SM1B272 | pDR000030 260 | GACATCGTGATGACCCAGAGCCAGAAATTCA TGAGCACCAGCGTGGGCGACCGGGTGTCCGT GACATGCAAGGCCAGCCAGAACGTGGGCAC CAACGTGGCCTGGTATCAGCAGAAGCCCGGC CAGAGCCCCAAGGCCCTGATCTACAGCGCCA GCTACAGATACAGCGGCGTGCCCGACAGATT CACAGGCAGCGGCTCTGGCACCGACTTCACC CTGACCATCAGCAACGTGCAGAGCGAGGACC | 953 |

TABLE 28-continued

LukAB Antibody Light Chain CDSs

| mAB/ Fab name | Construct ID | Light Chain CDS | SEQ ID NO: |
|---|---|---|---|
| | | TGGCCGAGTACTTCTGCCAGCAGTACAACAG CTACCCCTTCACCTTCGGCAGCGGCACCAAG CTGGAAATCAAGCGGGCTGATGCTGCACCGA CTGTGTCCATCTTCCCACCATCCAGTGAGCAG TTAACATCTGGAGGTGCCTCAGTCGTGTGCTT CTTGAACAACTTCTACCCCAAAGACATCAAT GTCAAGTGGAAGATTGATGGCAGTGAACGAC AAAATGGCGTCCTGAACAGTTGGACTGATCA GGACAGCAAAGACAGCACCTACAGCATGAG CAGCACCCTCACGTTGACCAAGGACGAGTAT GAACGACATAACAGCTATACCTGTGAGGCCA CTCACAAGACATCAACTTCACCCATTGTCAA GAGCTTCAACAGGAATGAGTGT | |
| SM1B273 | pDR000030 261 | GACATCGTGATGAGCCAGAGCCCTAGCAGCC TGGCCGTGTCCGTGGGCGAGAAAGTGACCAT GAGCTGCAAGAGCAGCCAGTCCCTGCTGTAC TCCAGCAACCAGAAGAACTACCTGGCCTGGT ATCAGCAGAAGCCCGGCCAGTCCCCTAAGCT GCTGATCTACTGGGCCAGCACCAGAGAAAGC GGCGTGCCCGATAGATTCACAGGCAGCGGCT CCGGCACCGACTTCACCCTGACAATCAGCAG CGTGAAGGCCGAGGACCTGGCTGTGTACTAC TGCCAGCAGTACTACAGCTACCCCTACACCT TCGGCGGAGGCACCAAGCTGGAAATCAAGC GGGCTGATGCTGCACCGACTGTGTCCATCTTC CCACCATCCAGTGAGCAGTTAACATCTGGAG GTGCCTCAGTCGTGTGCTTCTTGAACAACTTC TACCCCAAAGACATCAATGTCAAGTGGAAGA TTGATGGCAGTGAACGACAAAATGGCGTCCT GAACAGTTGGACTGATCAGGACAGCAAAGA CAGCACCTACAGCATGAGCAGCACCCTCACG TTGACCAAGGACGAGTATGAACGACATAACA GCTATACCTGTGAGGCCACTCACAAGACATC AACTTCACCCATTGTCAAGAGCTTCAACAGG AATGAGTGT | 954 |
| SM1B274 | pDR000030 262 | GACGTCGTGATGACCCAGACACCCCTGAGCC TGCCTGTGTCTCTGGGCGATCAGGCCAGCAT CAGCTGCAGATCCAGCCAGAGCCTGGTGCAC AGCAACGGCAACACCTACCTGCACTGGTATC TGCAGAAGCCCGGCCAGAGCCCCAAGCTGCT GATCTACAAGGTGTCCAACAGATTCAGCGGC GTGCCCGACAGATTCTCTGGCAGCGGCTCTG GCACCGACTTCACCCTGAAGATCAGCCGGGT GGAAGCCGAGGACCTGGGCGTGTACTTCTGC AGCCAGTCCACCCACGTGCCACCCTACACCT TTGGCGGAGGCACCAAGCTGGAACTGAAGCG GGCTGATGCTGCACCGACTGTGTCCATCTTCC CACCATCCAGTGAGCAGTTAACATCTGGAGG TGCCTCAGTCGTGTGCTTCTTGAACAACTTCT ACCCCAAAGACATCAATGTCAAGTGGAAGAT TGATGGCAGTGAACGACAAAATGGCGTCCTG AACAGTTGGACTGATCAGGACAGCAAAGAC AGCACCTACAGCATGAGCAGCACCCTCACGT TGACCAAGGACGAGTATGAACGACATAACA GCTATACCTGTGAGGCCACTCACAAGACATC AACTTCACCCATTGTCAAGAGCTTCAACAGG AATGAGTGT | 955 |
| 5M1B275 | pDR000030 263 | GACGTCGTGATGACCCAGACCCCTCTGACCC TGAGCGTGACAATCGGCCAGCCTGCCAGCAT CAGCTGCAAGAGCAGCCAGAGCCTGCTGTAC TCCAACGGCAAGACCTACCTGAACTGGCTGC TGCAGAGGCCTGGCCAGAGCCCCAAGAGACT GATCTACCTGGTGTCCAAGCTGGACAGCGGC GTGCCCGATAGATTCACAGGCAGCGGCTCCG GCACCGACTTCACCCTGAAGATCAGCCGGGT GGAAGCCGAGGACCTGGGCGTGTTCTACTGT GTGCAGGGCACCCACTTCCCTCAGACCTTCG GCGGAGGCACAAAGCTGGAACTGAAGCGGG CTGATGCTGCACCGACTGTGTCCATCTTCCCA | 956 |

TABLE 28-continued

LukAB Antibody Light Chain CDSs

| mAB/<br>Fab name | Con-<br>struct ID | Light Chain CDS | SEQ ID NO: |
|---|---|---|---|
| | | CCATCCAGTGAGCAGTTAACATCTGGAGGTG<br>CCTCAGTCGTGTGCTTCTTGAACAACTTCTAC<br>CCCAAAGACATCAATGTCAAGTGGAAGATTG<br>ATGGCAGTGAACGACAAAATGGCGTCCTGAA<br>CAGTTGGACTGATCAGGACAGCAAAGACAGC<br>ACCTACAGCATGAGCAGCACCCTCACGTTGA<br>CCAAGGACGAGTATGAACGACATAACAGCTA<br>TACCTGTGAGGCCACTCACAAGACATCAACT<br>TCACCCATTGTCAAGAGCTTCAACAGGAATG<br>AGTGT | |

TABLE 29

LukAB Antibody Light Chain Primary Transcripts

| mAB/<br>Fab name | Con-<br>struct ID | Light Chain Primary Transcript | SEQ ID NO: |
|---|---|---|---|
| SM1B105 | pDR000023603 | ATGGAGACACATTCTCAGGTCTTTGTATACA<br>TGTTGCTGTGGTTGTCTGGTGTCGAGGGCGA<br>TATTGTGCTAACTCAGTCTCCAGCAATAATG<br>GCTGCCTCTCTGGGGCAGAAGGTCACCATG<br>ACCTGCAGTGCCAGCTCAAGTGTAAGTTCC<br>AGTTACTTGCACTGGTACCAGCAGAAGTCA<br>GGCGCTTCCCCCAAACCCTTGATTCATAGGA<br>CATCCAACCTGGCTTCTGGAGTCCCAGCTCG<br>CTTCAGTGGCAGTGGGTCTGGGACCTCTTAC<br>TCTCTCACAATCAGCAGCGTGGAGGCTGAA<br>GATGATGCAACTTATTACTGCCAGCAGTGG<br>AGTGGTTACCCATTCACGTTCGGTGCTGGGA<br>CCAAGCTGGAGCTGAAACGGGCTGATGCTG<br>CACCAACTGTATCCATCTTCCCACCATCCAG<br>TGAGCAGTTAACATCTGGAGGTGCCTCAGT<br>CGTGTGCTTCTTGAACAACTTCTACCCCAAA<br>GACATCAATGTCAAGTGGAAGATTGATGGC<br>AGTGAACGACAAAATGGCGTCCTGAACAGT<br>TGGACTGATCAGGACAGCAAAGACAGCACC<br>TACAGCATGAGCAGCACCCTCACGTTGACC<br>AAGGACGAGTATGAACGACATAACAGCTAT<br>ACCTGTGAGGCCACTCACAAGACATCAACT<br>TCACCCATTGTCAAGAGCTTCAACAGGAAT<br>GAGTGTTAG | 957 |
| SM1B106 | pDR000023628 | ATGGAGACACATTCTCAGGTCTTTGTATACA<br>TGTTGCTGTGGTTGTCTGGTGTCGAGGGCGA<br>CATTGTGATGACCCAGTCTCCAGCTTCTTTG<br>GCTGTGTCTCTAGGGCAGAGGGCCACCATC<br>TCCTGCAGAGCCAGCGAAAGTGTTGATAAT<br>TCTGGCATTAGTTTTATGAACTGGTTCCAAC<br>AGAAACCAGGACAGCCACCCAAACTCCTCA<br>TCTATGCTGCATCCAACCAAGGATCCGGGG<br>TCCCTGCCAGGTTTAGTGGCAGTGGGTCTGG<br>GACAGACTTCAGCCTCAACATCCATCCTATG<br>GAGGAGGATGATACTGCAATGTATTTCTGTC<br>AGCAAAGTAAGGAGGTTCCGTACACGTTCG<br>GAGGGGGGACCAAGCTGGAAATAAAACGG<br>GCTGATGCTGCACCAACTGTATCCATCTTCC<br>CACCATCCAGTGAGCAGTTAACATCTGGAG<br>GTGCCTCAGTCGTGTGCTTCTTGAACAACTT<br>CTACCCCAAAGACATCAATGTCAAGTGGAA<br>GATTGATGGCAGTGAACGACAAAATGGCGT<br>CCTGAACAGTTGGACTGATCAGGACAGCAA<br>AGACAGCACCTACAGCATGAGCAGCACCCT<br>CACGTTGACCAAGGACGAGTATGAACGACA<br>TAACAGCTATACCTGTGAGGCCACTCACAA<br>GACATCAACTTCACCCATTGTCAAGAGCTTC<br>AACAGGAATGAGTGTTAG | 958 |

TABLE 29-continued

LukAB Antibody Light Chain Primary Transcripts

| mAB/Fab name | Construct ID | Light Chain Primary Transcript | SEQ ID NO: |
|---|---|---|---|
| SM1B107 | pDR000023626 | ATGGAGACACATTCTCAGGTCTTTGTATACA TGTTGCTGTGGTTGTCTGGTGTCGAGGGCGA TATTGTGCTAACTCAGTCTCCAGCTTCTTTG GCTGTGTCTCTAGGGCAGAGGGCCACCATC TCCTGCAGAGCCAGCGAAAGTGTTGATAAT TCTGGCATTAGTTTTATGAACTGGTTCCAAC AGAAACCAGGACAGCCACCCAAACTCCTCA TCTATGCTGCATCCAACCAAGGATCCGGGG TCCCTGCCAGGTTTAGTGGCAGTGGGTCTGG GACAGACTTCAGCCTCAACATCCATCCTATG GAGGAGGATGATACTGCAATGTATTTCTGTC AGCAAAGTAAGGAGGTTCCGTACACGTTCG GAGGGGGGACCAAGCTGGAAATAAAACGG GCTGATGCTGCACCAACTGTATCCATCTTCC CACCATCCAGTGAGCAGTTAACATCTGGAG GTGCCTCAGTCGTGTGCTTCTTGAACAACTT CTACCCCAAAGACATCAATGTCAAGTGGAA GATTGATGGCAGTGAACGACAAAATGGCGT CCTGAACAGTTGGACTGATCAGGACAGCAA AGACAGCACCTACAGCATGAGCAGCACCCT CACGTTGACCAAGGACGAGTATGAACGACA TAACAGCTATACCTGTGAGGCCACTCACAA GACATCAACTTCACCCATTGTCAAGAGCTTC AACAGGAATGAGTGTTAG | 959 |
| SM1B108 | pDR000023627 | ATGGAGACACATTCTCAGGTCTTTGTATACA TGTTGCTGTGGTTGTCTGGTGTCGAGGGCGA TGTTGTGATGACCCAAACTCCCAAATTCCTG CTTGTATCAGCAGGAGACAGGGTTACCATT ACCTGCAAGGCCAGTCAGAGTGTGAGTGAT GATGTAACTTGGTACCAACAGAAGTCAGGA CAGTCTCCTAAACTGCTGATATACTATGCAT CCAATCGCTACACTGGAGTCCCTGATCGCTT CACTGGCAGTGGATATGGGACGGATTTCAC TTTTCACCATCAGCACTGTGCAGGCTGAAGA CCTGGCAGTTTATTTCTGTCAGCAGGATTAT AGCTCTCCGTGGACGTTCGGTGGAGGCACC AAGCTGGAAATCAAACGGGCTGATGCTGCA CCAACTGTATCCATCTTCTCACCATCCAGTG AGCAGTTAACATCTGGAGGTGCCTCAGTCG TGTGCTTCTTGAACAACTTCTACCCCAAAGA CATCAATGTCAAGTGGAAGATTGATGGCAG TGAACGACAAAATGGCGTCCTGAACAGTTG GACTGATCAGGACAGCAAAGACAGCACCTA CAGCATGAGCAGCACCCTCACGTTGACCAA GGACGAGTATGAACGACATAACAGCTATAC CTGTGAGGCCACTCACAAGACATCAACTTC ACCCATTGTCAAGAGCTTCAACAGGAATGA GTGTTAG | 960 |
| SM1B109 | pDR000023628 | ATGGAGACACATTCTCAGGTCTTTGTATACA TGTTGCTGTGGTTGTCTGGTGTCGAGGGCGA CATTGTGATGACCCAGTCTCCAGCTTCTTTG GCTGTGTCTCTAGGGCAGAGGGCCACCATC TCCTGCAGAGCCAGCGAAAGTGTTGATAAT TCTGGCATTAGTTTTATGAACTGGTTCCAAC AGAAACCAGGACAGCCACCCAAACTCCTCA TCTATGCTGCATCCAACCAAGGATCCGGGG TCCCTGCCAGGTTTAGTGGCAGTGGGTCTGG GACAGACTTCAGCCTCAACATCCATCCTATG GAGGAGGATGATACTGCAATGTATTTCTGTC AGCAAAGTAAGGAGGTTCCGTACACGTTCG GAGGGGGGACCAAGCTGGAAATAAAACGG GCTGATGCTGCACCAACTGTATCCATCTTCC CACCATCCAGTGAGCAGTTAACATCTGGAG GTGCCTCAGTCGTGTGCTTCTTGAACAACTT CTACCCCAAAGACATCAATGTCAAGTGGAA GATTGATGGCAGTGAACGACAAAATGGCGT CCTGAACAGTTGGACTGATCAGGACAGCAA AGACAGCACCTACAGCATGAGCAGCACCCT CACGTTGACCAAGGACGAGTATGAACGACA | 961 |

TABLE 29-continued

LukAB Antibody Light Chain Primary Transcripts

| mAB/<br>Fab name | Con-<br>struct ID | Light Chain Primary Transcript | SEQ ID NO: |
| --- | --- | --- | --- |
| | | TAACAGCTATACCTGTGAGGCCACTCACAA<br>GACATCAACTTCACCCATTGTCAAGAGCTTC<br>AACAGGAATGAGTGTTAG | |
| SM1B110 | pDR000023<br>629 | ATGGAGACACATTCTCAGGTCTTTGTATACA<br>TGTTGCTGTGGTTGTCTGGTGTCGAGGGCGA<br>TATTGTGCTAACTCAGTCTCCAGCAATCATG<br>TCTGCATCTCCAGGGGAGAAGGTCACCATA<br>ACCTGCAGTGCCAGCTCAAGTGTAAGTTAC<br>ATGCACTGGTTCCAGCAGAAGCCAGGCACT<br>TCTCCCAAACTCTGGATTTATAGCACATCCA<br>ACCTGGCTTCTGGAGTCCCTGCTCGCTTCAG<br>TGGCAGTGGATCTGGGACCTCTTACTCTCTC<br>ACAATCAGCCGAATGGAGGCTGAAGATGCT<br>GCCACTTATTACTGCCAGCAAAGGAGTAGT<br>TACCCATTCACGTTCGGCTCGGGGACAAAG<br>TTGGAAATAAAACGGGCTGATGCTGCACCA<br>ACTGTATCCATCTTCCCACCATCCAGTGAGC<br>AGTTAACATCTGGAGGTGCCTCAGTCGTGTG<br>CTTCTTGAACAACTTCTACCCCAAAGACATC<br>AATGTCAAGTGGAAGATTGATGGCAGTGAA<br>CGACAAAATGGCGTCCTGAACAGTTGGACT<br>GATCAGGACAGCAAAGACAGCACCTACAGC<br>ATGAGCAGCACCCTCACGTTGACCAAGGAC<br>GAGTATGAACGACATAACAGCTATACCTGT<br>GAGGCCACTCACAAGACATCAACTTCACCC<br>ATTGTCAAGAGCTTCAACAGGAATGAGTGT<br>TAG | 962 |
| SM1B111 | pDR000023<br>631 | ATGGAGACACATTCTCAGGTCTTTGTATACA<br>TGTTGCTGTGGTTGTCTGGTGTCGAGGGCGA<br>CATTGTGATGACCCAGTCTCCAACCACCATG<br>GCTGCATCTCCCGGGGAGAGGATCACTATC<br>ACCTGCAGTGCCCACTCAAATTTAATTTCCA<br>ATTACTTACATTGGTATCAGCAGAAGCCAG<br>GATTCTCCCCTAAACTCTTGATTTATAGGAC<br>ATCCAATCTGGCTTCTGGAGTCCCTGCTCGC<br>TTCAGTGGCAGTGGGTCTGGGACCTCTTACT<br>CTCTCACAATTGGCACCATGGAGGCTGAAG<br>ATGTTGCCACTTACTTCTGCCAACAGGGTAG<br>TAGTATACCATTCACGTTCGGCTCGGGGACA<br>AAGTTGGAAATAAAACGGGCTGATGCTGCA<br>CCAACTGTATCCATCTTCCCACCATCCAGTG<br>AGCAGTTAACATCTGGAGGTGCCTCAGTCG<br>TGTGCTTCTTGAACAACTTCTACCCCAAAGA<br>CATCAATGTCAAGTGGAAGATTGATGGCAG<br>TGAACGACAAAATGGCGTCCTGAACAGTTG<br>GACTGATCAGGACAGCAAAGACAGCACCTA<br>CAGCATGAGCAGCACCCTCACGTTGACCAA<br>GGACGAGTATGAACGACATAACAGCTATAC<br>CTGTGAGGCCACTCACAAGACATCAACTTC<br>ACCCATTGTCAAGAGCTTCAACAGGAATGA<br>GTGTTAG | 963 |
| SM1B112 | pDR000023<br>630 | ATGGAGACACATTCTCAGGTCTTTGTATACA<br>TGTTGCTGTGGTTGTCTGGTGTCGAGGGCCA<br>AATTGTTCTCACCCAGTCTCCAACAATCATG<br>TCTGCATCTCCAGGGGAAAAGGTCACCATG<br>ACCTGCAGTGCCAGCTCACATGTAAGTTAC<br>ATATACTGGTACCAGCAGAAGCCAGGCTCC<br>TCCCCCAGACTCTGGATTTATGACACATCCA<br>ACCTGGTTTCTGGAGTCCCTGCTCGCTTCAG<br>TGGCAGTAGGTCTGGGACCTCTTATTCTCTC<br>ACAATCAGCAGCATGGAGGCTGAAGATGCT<br>GCCACTTATTACTGCCAGCAGTACAGTGGTT<br>ACCCGTACACGTTCGGAGGGGGGACCAAGC<br>TGGAAATAAAACGGGCTGATGCTGCACCAA<br>CTGTATCCATCTTCCCACCATCCAGTGAGCA<br>GTTAACATCTGGAGGTGCCTCAGTCGTGTGC<br>TTCTTGAACAACTTCTACCCCAAAGACATCA<br>ATGTCAAGTGGAAGATTGATGGCAGTGAAC<br>GACAAAATGGCGTCCTGAACAGTTGGACTG | 964 |

TABLE 29-continued

LukAB Antibody Light Chain Primary Transcripts

| mAB/ Fab name | Construct ID | Light Chain Primary Transcript | SEQ ID NO: |
|---|---|---|---|
| | | ATCAGGACAGCAAAGACAGCACCTACAGCA TGAGCAGCACCCTCACGTTGACCAAGGACG AGTATGAACGACATAACAGCTATACCTGTG AGGCCACTCACAAGACATCAACTTCACCCA TTGTCAAGAGCTTCAACAGGAATGAGTGTT AG | |
| 5M1B243 | pDR000030 110 | ATGGAGACACATTCTCAGGTCTTTGTATACA TGTTGCTGTGGTTGTCTGGTGTCGAGGGCGA CATCAAGATGACCCAGAGCCCCAGCTCTAT GTACGCCAGCCTGGGCGAGCGCGTGACCAT CACCTGTAAAGCCAGCCAGGACATCAACAG CTACCTGAGCTGGTTCCAGCAGAAGCCCGG CAAGAGCCCCAAGACCCTGATCTACCGGGC CAACAGACTGGTGGACGGCGTGCCAAGCAG ATTCAGCGGCTCTGGCAGCGGCCAGGACTA CAGCCCTACCATCAGCAGCCTGGAATACGA GGACATGGGCATCTACTACTGCCTGCAGTA CGACGAGTTCCCCTACACCTTCGGCGGAGG CACCAAGCTGGAAATCAAGCGGGCTGATGC TGCACCGACTGTGTCCATCTTCCCACCATCC AGTGAGCAGTTAACATCTGGAGGTGCCTCA GTCGTGTGCTTCTTGAACAACTTCTACCCCA AAGACATCAATGTCAAGTGGAAGATTGATG GCAGTGAACGACAAAATGGCGTCCTGAACA GTTGGACTGATCAGGACAGCAAAGACAGCA CCTACAGCATGAGCAGCACCCTCACGTTGA CCAAGGACGAGTATGAACGACATAACAGCT ATACCTGTGAGGCCACTCACAAGACATCAA CTTCACCCATTGTCAAGAGCTTCAACAGGA ATGAGTGTTAG | 965 |
| SM1B244 | pDR000030 235 | ATGGAGACACATTCTCAGGTCTTTGTATACA TGTTGCTGTGGTTGTCTGGTGTCGAGGGCGA CATCGTGATGACCCAGAGCCAGAAATTCAT GAGCACCAGCGTGGGCGACCGGGTGTCCGT GACATGCAAGGCCAGCCAGAACGTGGGCAC CAACGTGGCCTGGTATCAGCAGAAGCCCGG CCAGAGCCCCAAGACCCTGATCTACAGCGC CAGCTACAGATACAGCGGCGTGCCCGATAG CTTCACAGGCAGCGGCTCTGGCACCGACTTC ACCCTGACCATCAGCAACGTGCAGAGCGAG GACTGGGCCGAGTACTTCTGCCAGCAGTAC AACAGCTACCCCTTCACCTTCGGCAGCGGC ACCAAGCTGGAAATCAAGCGGGCTGATGCT GCACCGACTGTGTCCATCTTCCCACCATCCA GTGAGCAGTTAACATCTGGAGGTGCCTCAG TCGTGTGCTTCTTGAACAACTTCTACCCCAA AGACATCAATGTCAAGTGGAAGATTGATGG CAGTGAACGACAAAATGGCGTCCTGAACAG TTGGACTGATCAGGACAGCAAAGACAGCAC CTACAGCATGAGCAGCACCCTCACGTTGAC CAAGGACGAGTATGAACGACATAACAGCTA TACCTGTGAGGCCACTCACAAGACATCAAC TTCACCCATTGTCAAGAGCTTCAACAGGAAT GAGTGTTAG | 966 |
| SM1B245 | pDR000030 236 | ATGGAGACACATTCTCAGGTCTTTGTATACA TGTTGCTGTGGTTGTCTGGTGTCGAGGGCGA CATCGTGCTGACACAGTCTCCAGCCAGCCTG GCCGTGTCTCTGGGACAGAGGGCCACCATG AGCTGCAGAGCCAGCGAGTCTGTGGACGGC TACGGCAACAGCTTCCTGCACTGGTATCAGC AGAAGCCCGGCCAGCCTCCCAAGCTGCTGA TCTACAGGGCCAGCAACCTGGAAAGCGGCA TCCCCGCCAGATTCAGCGGCACCGGCAGCA GAACCGACTTCACCCTGACCATCACCCCTGT GGAAGCCGACGACGTGGCCACCTACTACTG CCAGCAGAGCAACGGCGACCCCTTCACCTT CGGCTCCGGCACCAAGCTGGAAATCAAGCG GGCTGATGCTGCACCGACTGTGTCCATCTTC CCACCATCCAGTGAGCAGTTAACATCTGGA | 967 |

TABLE 29-continued

LukAB Antibody Light Chain Primary Transcripts

| mAB/Fab name | Construct ID | Light Chain Primary Transcript | SEQ ID NO: |
|---|---|---|---|
| | | GGTGCCTCAGTCGTGTGCTTCTTGAACAACT<br>TCTACCCCAAAGACATCAATGTCAAGTGGA<br>AGATTGATGGCAGTGAACGACAAAATGGCG<br>TCCTGAACAGTTGGACTGATCAGGACAGCA<br>AAGACAGCACCTACAGCATGAGCAGCACCC<br>TCACGTTGACCAAGGACGAGTATGAACGAC<br>ATAACAGCTATACCTGTGAGGCCACTCACA<br>AGACATCAACTTCACCCATTGTCAAGAGCTT<br>CAACAGGAATGAGTGTTAG | |
| SM1B246 | pDR000030237 | ATGGAGACACATTCTCAGGTCTTTGTATACA<br>TGTTGCTGTGGTTGTCTGGTGTCGAGGGCGA<br>CGTGCTGATGACCCAGACACCCCTGAGCCT<br>GCCTGTGTCTCTGGGCGATCAGGCCAGCATC<br>AGCTGCCGGTCTAGCCAGAGCATCGTGCAC<br>AGCAACGGCAAGACCTACCTGGAATGGTAT<br>CTGCAGAAGCCCGGCCAGAGCCCCAAGCTG<br>CTGATCTACAAGGTGTCCAACAGATTCAGC<br>GGCGTGCCCGACAGATTCTCTGGCAGCGGC<br>TCTGGCACCGACTTCACCCTGAAGATCAGCC<br>GGGTGGAAGCCGAGGACCTGGGCGTGTACT<br>ACTGTCTGCAGGGCAGCCACGTGCCCTGGA<br>CCTTTGGCGGCGGAACAAAGCTGGAACTGA<br>AGCGGGCTGATGCTGCACCGACTGTGTCCA<br>TCTTCCCACCATCCAGTGAGCAGTTAACATC<br>TGGAGGTGCCTCAGTCGTGTGCTTCTTGAAC<br>AACTTCTACCCCAAAGACATCAATGTCAAG<br>TGGAAGATTGATGGCAGTGAACGACAAAAT<br>GGCGTCCTGAACAGTTGGACTGATCAGGAC<br>AGCAAAGACAGCACCTACAGCATGAGCAGC<br>ACCCTCACGTTGACCAAGGACGAGTATGAA<br>CGACATAACAGCTATACCTGTGAGGCCACT<br>CACAAGACATCAACTTCACCCATTGTCAAG<br>AGCTTCAACAGGAATGAGTGTTAG | 968 |
| SM1B247 | pDR000030238 | ATGGAGACACATTCTCAGGTCTTTGTATACA<br>TGTTGCTGTGGTTGTCTGGTGTCGAGGGCGA<br>CATCGTGCTGACACAGTCTCCAGCCAGCCTG<br>GCCGTGTCTCTGGGACAGAGAGCCACCATC<br>AGCTGCCGGGCCAGCAAGAGCGTGTCCATC<br>AGCGGCTACAGCTACATGCACTGGTATCAG<br>CAGAAGCCCGGCCAGCCTCCCAAGCTGCTG<br>ATCGACCTGGCCAGCAACCTGGAAAGCGGC<br>GTGCCAGCCAGATTTTCTGGCAGCGGCTCCG<br>GCACCGACTTCACCCTGAACATCCACCCCGT<br>GGAAGAAGAGGACGCCGCCACCTACTACTG<br>CCAGCACAGCAGAGAGCTGCCCTTCACCTT<br>CGGCAGCGGCACCAAGCTGGAAATCAAGCG<br>GGCTGATGCTGCACCGACTGTGTCCATCTTC<br>CCACCATCCAGTGAGCAGTTAACATCTGGA<br>GGTGCCTCAGTCGTGTGCTTCTTGAACAACT<br>TCTACCCCAAAGACATCAATGTCAAGTGGA<br>AGATTGATGGCAGTGAACGACAAAATGGCG<br>TCCTGAACAGTTGGACTGATCAGGACAGCA<br>AAGACAGCACCTACAGCATGAGCAGCACCC<br>TCACGTTGACCAAGGACGAGTATGAACGAC<br>ATAACAGCTATACCTGTGAGGCCACTCACA<br>AGACATCAACTTCACCCATTGTCAAGAGCTT<br>CAACAGGAATGAGTGTTAG | 969 |
| SM1B248 | pDR000030236 | ATGGAGACACATTCTCAGGTCTTTGTATACA<br>TGTTGCTGTGGTTGTCTGGTGTCGAGGGCGA<br>CATCGTGCTGACACAGTCTCCAGCCAGCCTG<br>GCCGTGTCTCTGGGACAGAGGGCCACCATG<br>AGCTGCAGAGCCAGCGAGTCTGTGGACGGC<br>TACGGCAACAGCTTCCTGCACTGGTATCAGC<br>AGAAGCCCGGCCAGCCTCCCAAGCTGCTGA<br>TCTACAGGGCCAGCAACCTGGAAAGCGGCA<br>TCCCCGCCAGATTCAGCGGCACCGGCAGCA<br>GAACCGACTTCACCCTGACCATCACCCCTGT<br>GGAAGCCGACGACGTGGCCACCTACTACTG<br>CCAGCAGAGCAACGGCGACCCCTTCACCTT | 970 |

TABLE 29-continued

LukAB Antibody Light Chain Primary Transcripts

| mAB/Fab name | Construct ID | Light Chain Primary Transcript | SEQ ID NO: |
|---|---|---|---|
| | | CGGCTCCGGCACCAAGCTGGAAATCAAGCG<br>GGCTGATGCTGCACCGACTGTGTCCATCTTC<br>CCACCATCCAGTGAGCAGTTAACATCTGGA<br>GGTGCCTCAGTCGTGTGCTTCTTGAACAACT<br>TCTACCCCAAAGACATCAATGTCAAGTGGA<br>AGATTGATGGCAGTGAACGACAAAATGGCG<br>TCCTGAACAGTTGGACTGATCAGGACAGCA<br>AAGACAGCACCTACAGCATGAGCAGCACCC<br>TCACGTTGACCAAGGACGAGTATGAACGAC<br>ATAACAGCTATACCTGTGAGGCCACTCACA<br>AGACATCAACTTCACCCATTGTCAAGAGCTT<br>CAACAGGAATGAGTGTTAG | |
| SM1B249 | pDR000030239 | ATGGAGACACATTCTCAGGTCTTTGTATACA<br>TGTTGCTGTGGTTGTCTGGTGTCGAGGGCCA<br>GATCGTGCTGACCCAGAGCCCTGCCATCAT<br>GTCTGCCAGCCCTGGCGAGAAAGTGACCAT<br>GACCTGTAGCGCCAGCAGCAGCGTGTCCTA<br>CATGCACTGGTATCAGCAGAAGTCCGGCAC<br>CAGCCCCAAGCGGTGGATCTACGATACCAG<br>CAAGCTGGCCTCCGGCGTGCCAGCCAGATT<br>TTCTGGCTCTGGCAGCGGCACCTCCTACAGC<br>CTGACCATCAGCAGCATGGAAGCCGAGGAC<br>GCCGCCACCTACTACTGCCAGCAGTGGATC<br>AGCAACCCTCCCACCTTCGGCGGAGGCACC<br>AAGCTGGAAATCAAGCGGGCTGATGCTGCA<br>CCGACTGTGTCCATCTTCCCACCATCCAGTG<br>AGCAGTTAACATCTGGAGGTGCCTCAGTCG<br>TGTGCTTCTTGAACAACTTCTACCCCAAAGA<br>CATCAATGTCAAGTGGAAGATTGATGGCAG<br>TGAACGACAAAATGGCGTCCTGAACAGTTG<br>GACTGATCAGGACAGCAAAGACAGCACCTA<br>CAGCATGAGCAGCACCCTCACGTTGACCAA<br>GGACGAGTATGAACGACATAACAGCTATAC<br>CTGTGAGGCCACTCACAAGACATCAACTTC<br>ACCCATTGTCAAGAGCTTCAACAGGAATGA<br>GTGTTAG | 971 |
| SM1B250 | pDR000030240 | ATGGAGACACATTCTCAGGTCTTTGTATACA<br>TGTTGCTGTGGTTGTCTGGTGTCGAGGGCGA<br>CATCGTGCTGACACAGTCTCCAGCCAGCCTG<br>GCCGTGTCCCTGGAACAGAGAGCCACCATC<br>AGCTGCAAGGCCAGCCAGAGCGTGGACTAC<br>GACGGCGACAGCTACATGAACTGGTATCAG<br>CAGAAGCCCGGCCAGCCTCCCAAGCTGCTG<br>ATCTACGCCGCCAGCAACCTGGAAAGCGGC<br>ATCCCTGCCAGATTCAGCGGCAGCGGCTCT<br>GGCACCGACTTCACCCTGAACATCCACCCC<br>GTGGAAGAAGAGGACGCCGCCACCTACTAC<br>TGCCAGCAGAGCAACGAGGACCCTCTGACC<br>TTCGGAGCCGGCACCAAGCTGGAACTGAAG<br>CGGGCTGATGCTGCACCGACTGTGTCCATCT<br>TCCCACCATCCAGTGAGCAGTTAACATCTGG<br>AGGTGCCTCAGTCGTGTGCTTCTTGAACAAC<br>TTCTACCCCAAAGACATCAATGTCAAGTGG<br>AAGATTGATGGCAGTGAACGACAAAATGGC<br>GTCCTGAACAGTTGGACTGATCAGGACAGC<br>AAAGACAGCACCTACAGCATGAGCAGCACC<br>CTCACGTTGACCAAGGACGAGTATGAACGA<br>CATAACAGCTATACCTGTGAGGCCACTCAC<br>AAGACATCAACTTCACCCATTGTCAAGAGC<br>TTCAACAGGAATGAGTGTTAG | 972 |
| SM1B251 | pDR000030241 | ATGGAGACACATTCTCAGGTCTTTGTATACA<br>TGTTGCTGTGGTTGTCTGGTGTCGAGGGCGA<br>CATCCAGATGACCCAGAGCCCTGCCAGCCT<br>GAGCGCCTCTGTGGGCGAGACAGTGACCAC<br>CATCTGCCGGGCCAGCGAGAACATCTACAG<br>CTACCTGGCCTGGTATCAGCAGAAGCAGGG<br>CAAGAGCCCTCAGCTGCTGGTGTACAACGC<br>CAAGACCCTGGTGAAGGCGTGCCCAGCAG<br>ATTTTCTGGCTCTGGCAGCGGCACCCAGTTC | 973 |

TABLE 29-continued

LukAB Antibody Light Chain Primary Transcripts

| mAB/Fab name | Construct ID | Light Chain Primary Transcript | SEQ ID NO: |
|---|---|---|---|
| | | AGCCTGAAGATCAACAGCCTGCAGCCCGAG<br>GACTTCGGCAGCTACTACTGCCAGCACCACT<br>ACGGCAGCCCCTACACCTTTGGCGGAGGCA<br>CCAAGCTGGAACTGAAGCGGGCTGATGCTG<br>CACCGACTGTGTCCATCTTCCCACCATCCAG<br>TGAGCAGTTAACATCTGGAGGTGCCTCAGT<br>CGTGTGCTTCTTGAACAACTTCTACCCCAAA<br>GACATCAATGTCAAGTGGAAGATTGATGGC<br>AGTGAACGACAAAATGGCGTCCTGAACAGT<br>TGGACTGATCAGGACAGCAAAGACAGCACC<br>TACAGCATGAGCAGCACCCTCACGTTGACC<br>AAGGACGAGTATGAACGACATAACAGCTAT<br>ACCTGTGAGGCCACTCACAAGACATCAACT<br>TCACCCATTGTCAAGAGCTTCAACAGGAAT<br>GAGTGTTAG | |
| SM1B252 | pDR000030<br>242 | ATGGAGACACATTCTCAGGTCTTTGTATACA<br>TGTTGCTGTGGTTGTCTGGTGTCGAGGGCGA<br>CGTGCTGATGACCCAGACACCCCTGAGCCT<br>GCCTGTGTCTCTGGGCGATCAGGCCAGCATC<br>AGCTGCCGGTCTAGCCAGAGCATCGTGTAC<br>AGCAACGGCAACACCTACCTGGAATGGTAT<br>CTGCAGAAGCCCGGCCAGAGCCCCAAGCTG<br>CTGATCTACAAGGTGTCCAACAGATTCAGC<br>GGCGTGCCCGACAGATTCTCTGGCAGCGGC<br>TCTGGCACCGACTTCACCCTGAAGATCAGCC<br>GGGTGGAAGCCGAGGACCTGGGCGTGTACT<br>ACTGTTTTCAGGGCAGCCACGTGCCCTTCAC<br>CTTCGGCAGCGGCACCAAGCTGGAAATCAA<br>GCGGGCTGATGCTGCACCGACTGTGTCCATC<br>TTCCCACCATCCAGTGAGCAGTTAACATCTG<br>GAGGTGCCTCAGTCGTGTGCTTCTTGAACAA<br>CTTCTACCCCAAAGACATCAATGTCAAGTG<br>GAAGATTGATGGCAGTGAACGACAAAATGG<br>CGTCCTGAACAGTTGGACTGATCAGGACAG<br>CAAAGACAGCACCTACAGCATGAGCAGCAC<br>CCTCACGTTGACCAAGGACGAGTATGAACG<br>ACATAACAGCTATACCTGTGAGGCCACTCA<br>CAAGACATCAACTTCACCCATTGTCAAGAG<br>CTTCAACAGGAATGAGTGTTAG | 974 |
| SM1B253 | pDR000030<br>243 | ATGGAGACACATTCTCAGGTCTTTGTATACA<br>TGTTGCTGTGGTTGTCTGGTGTCGAGGGCGA<br>CGTCGTGATGACCCAGACCCCTCTGACCCTG<br>AGCGTGACAATCGGCCAGGCCGCCAGCATC<br>AGCTGCAAGAGCAGCCAGAGCCTGCTGCAC<br>AGCGACGGCAAGACCTACCTGAACTGGCTG<br>CTGCAGAGGCCTGGCCAGAGCCCCAAGAGA<br>CTGATCTACCTGGTGTCCAAGCTGGACAGC<br>GGCGTGCCCGATAGATTCACAGGCAGCGGC<br>TCCGGCACCGACTTCACCCTGAAGATCAGC<br>CGGGTGGAAGCCGAGGACCTGGGCGTGTAC<br>TACTGCTGGCAGGGCACCCACTTCCCTTACA<br>CCTTCGGCGGAGGCACAAAGCTGGAAATCA<br>AGCGGGCTGATGCTGCACCGACTGTGTCCA<br>TCTTCCCACCATCCAGTGAGCAGTTAACATC<br>TGGAGGTGCCTCAGTCGTGTGCTTCTTGAAC<br>AACTTCTACCCCAAAGACATCAATGTCAAG<br>TGGAAGATTGATGGCAGTGAACGACAAAAT<br>GGCGTCCTGAACAGTTGGACTGATCAGGAC<br>AGCAAAGACAGCACCTACAGCATGAGCAGC<br>ACCCTCACGTTGACCAAGGACGAGTATGAA<br>CGACATAACAGCTATACCTGTGAGGCCACT<br>CACAAGACATCAACTTCACCCATTGTCAAG<br>AGCTTCAACAGGAATGAGTGTTAG | 975 |
| SM1B254 | pDR000030<br>244 | ATGGAGACACATTCTCAGGTCTTTGTATACA<br>TGTTGCTGTGGTTGTCTGGTGTCGAGGGCGA<br>CGTCGTGATGACCCAGACCCCTCTGACCCTG<br>AGCGTGACAGTGGGCCAGCCTGCCAGCATC<br>AGCTGCAAGAGCAGCCAGAGCCTGCTGCAC<br>AGCGACGGCAAGACCTACCTGAACTGGCTG | 976 |

TABLE 29-continued

LukAB Antibody Light Chain Primary Transcripts

| mAB/<br>Fab name | Construct ID | Light Chain Primary Transcript | SEQ ID NO: |
|---|---|---|---|
| | | CTGCAGAGGCCTGGCCAGAGCCCCAAGAGA<br>CTGATCTACCTGGTGTCCAAGCTGGACAGC<br>GGCGTGCCCGATAGATTCACAGGCAGCGGC<br>TCCGGCACCGACTTCACCCTGAAGATCAGC<br>CGGGTGGAAGCCGAGGACCTGGGCGTGTAC<br>TACTGTTGGCAGGGCACCCACTTCCCTTACA<br>CCTTCGGCGGAGGCACAAAGCTGGAAATCA<br>AGCGGGCTGATGCTGCACCGACTGTGTCCA<br>TCTTCCCACCATCCAGTGAGCAGTTAACATC<br>TGGAGGTGCCTCAGTCGTGTGCTTCTTGAAC<br>AACTTCTACCCCAAAGACATCAATGTCAAG<br>TGGAAGATTGATGGCAGTGAACGACAAAAT<br>GGCGTCCTGAACAGTTGGACTGATCAGGAC<br>AGCAAAGACAGCACCTACAGCATGAGCAGC<br>ACCCTCACGTTGACCAAGGACGAGTATGAA<br>CGACATAACAGCTATACCTGTGAGGCCACT<br>CACAAGACATCAACTTCACCCATTGTCAAG<br>AGCTTCAACAGGAATGAGTGTTAG | |
| SM1B255 | pDR000030<br>245 | ATGGAGACACATTCTCAGGTCTTTGTATACA<br>TGTTGCTGTGGTTGTCTGGTGTCGAGGGCGA<br>CGTCGTGATGACCCAGACCCCTCTGACCCTG<br>AGCGTGACAATCGGCCAGCCTGCCAGCATC<br>AGCTGCAAGAGCAGCCAGAGCCTGCTGGAC<br>AGCGACGGCGAGACATACCTGAACTGGCTG<br>CTGCAGAGGCCTGGCCAGAGCCCCAAGCGG<br>CTGATCTACATGGTGTCCAAGCTGGACTCCG<br>GCGTGCCCGACAGATTCACAGGCAGCGGCA<br>GCGGAACCGACTTCACCCTGAAGATCAGCA<br>GAGTGGAAGCCGAGGACCTGGGCGTGTACT<br>ACTGTTGGCAGGGCACCCACTTCCCTCAGAC<br>CTTCGGCGGAGGCACAAAGCTGGAACTGAA<br>GCGGGCTGATGCTGCACCGACTGTGTCCATC<br>TTCCCACCATCCAGTGAGCAGTTAACATCTG<br>GAGGTGCCTCAGTCGTGTGCTTCTTGAACAA<br>CTTCTACCCCAAAGACATCAATGTCAAGTG<br>GAAGATTGATGGCAGTGAACGACAAAATGG<br>CGTCCTGAACAGTTGGACTGATCAGGACAG<br>CAAAGACAGCACCTACAGCATGAGCAGCAC<br>CCTCACGTTGACCAAGGACGAGTATGAACG<br>ACATAACAGCTATACCTGTGAGGCCACTCA<br>CAAGACATCAACTTCACCCATTGTCAAGAG<br>CTTCAACAGGAATGAGTGTTAG | 977 |
| SM1B256 | pDR000030<br>246 | ATGGAGACACATTCTCAGGTCTTTGTATACA<br>TGTTGCTGTGGTTGTCTGGTGTCGAGGGCGA<br>CGTCGTGATGACCCAGACCCCTCTGACCCTG<br>AGCGTGACCAATGGCCAGCCTGCCAGCATC<br>AGCTGCAAGAGCAGCCAGAGCCTGCTGGAC<br>AGCGACGGCGAGACATACCTGAACTGGCTG<br>CTGCAGAGGCCTGGCCAGAGCCCCAAGAGA<br>CTGATCTACCTGGTGTCCAAGCTGGACTCCG<br>GCGTGCCCGACAGATTCATCGGCTCTGGCA<br>GCGGCACCGACTTCACCCTGAAGATCAGCC<br>GGGTGGAAGCCGAGGACCTGGGCGTGTACT<br>TCTGTTGGCAGGGCACCCACAGCCCCTACA<br>CCTTTTGGCGGCGGAACAAAGCTGGAAATCA<br>AGCGGGCTGATGCTGCACCGACTGTGTCCA<br>TCTTCCCACCATCCAGTGAGCAGTTAACATC<br>TGGAGGTGCCTCAGTCGTGTGCTTCTTGAAC<br>AACTTCTACCCCAAAGACATCAATGTCAAG<br>TGGAAGATTGATGGCAGTGAACGACAAAAT<br>GGCGTCCTGAACAGTTGGACTGATCAGGAC<br>AGCAAAGACAGCACCTACAGCATGAGCAGC<br>ACCCTCACGTTGACCAAGGACGAGTATGAA<br>CGACATAACAGCTATACCTGTGAGGCCACT<br>CACAAGACATCAACTTCACCCATTGTCAAG<br>AGCTTCAACAGGAATGAGTGTTAG | 978 |
| SM1B257 | pDR000030<br>247 | ATGGAGACACATTCTCAGGTCTTTGTATACA<br>TGTTGCTGTGGTTGTCTGGTGTCGAGGGCGA<br>CATCCAGATGACCCAGAGCCCTAGCAGCCT | 979 |

TABLE 29-continued

LukAB Antibody Light Chain Primary Transcripts

| mAB/Fab name | Construct ID | Light Chain Primary Transcript | SEQ ID NO: |
|---|---|---|---|
| | | GTCTGCCAGCCTGGGCGGCAAAGTGACCAT<br>CACATGCAAGGCCAGCCAGGACATCAACAA<br>GTATATCGCCTGGTATCAGCACAAGCCCGG<br>CAAGGGCCCCAGACTGCTGATCCACTACAC<br>CAGCACCCTGCAGCCCGGCATCCCTAGCAG<br>ATTTTCTGGCAGCGGCTCCGGCAGAGACTA<br>CAGCTTCAGCATCAGCAACCTGGAACCCGA<br>GGATATCGCCACCTACTACTGCCTGCAGTAC<br>GACAACCTGCGGACCTTCGGCGGAGGCACC<br>AAGGTGGAAATCAAGCGGGCTGATGCTGCA<br>CCGACTGTGTCCATCTTCCCACCATCCAGTG<br>AGCAGTTAACATCTGGAGGTGCCTCAGTCG<br>TGTGCTTCTTGAACAACTTCTACCCCAAAGA<br>CATCAATGTCAAGTGGAAGATTGATGGCAG<br>TGAACGACAAAATGGCGTCCTGAACAGTTG<br>GACTGATCAGGACAGCAAAGACAGCACCTA<br>CAGCATGAGCAGCACCCTCACGTTGACCAA<br>GGACGAGTATAACGACATAACAGCTATAC<br>CTGTGAGGCCACTCACAAGACATCAACTTC<br>ACCCATTGTCAAGAGCTTCAACAGGAATGA<br>GTGTTAG | |
| SM1B258 | pDR000030248 | ATGGAGACACATTCTCAGGTCTTTGTATACA<br>TGTTGCTGTGGTTGTCTGGTGTCGAGGGCGA<br>CGTGCTGATGACCCAGACACCCCTGAGCCT<br>GCCTGTGTCTCTGGGCGATCAGGCCAGCATC<br>AGCTGCCGGTCTAGCCAGAGCATCGTGCAC<br>AGCAACGGCAACACCTACCTGGAATGGTAT<br>CTGCAGAAGCCCGGCCAGAGCCCCAAGCTG<br>CTGATCTACAAGGTGTCCAACAGATTCAGC<br>GGCGTGCCCGACAGATTCTCTGGCAGCGGC<br>TCTGGCACCGACTTCACCCTGAAGATCAGCC<br>GGGTGGAAGCCGAGGACCTGGGCGTGTACT<br>ACTGTTTTCAGGGCAGCCACGTGCCCTTCAC<br>CTTCGGCAGCGGCACCAAGCTGGAAATCAA<br>GCGGGCTGATGCTGCACCGACTGTGTCCATC<br>TTCCCACCATCCAGTGAGCAGTTAACATCTG<br>GAGGTGCCTCAGTCGTGTGCTTCTTGAACAA<br>CTTCTACCCCAAAGACATCAATGTCAAGTG<br>GAAGATTGATGGCAGTGAACGACAAAATGG<br>CGTCCTGAACAGTTGGACTGATCAGGACAG<br>CAAAGACAGCACCTACAGCATGAGCAGCAC<br>CCTCACGTTGACCAAGGACGAGTATGAACG<br>ACATAACAGCTATACCTGTGAGGCCACTCA<br>CAAGACATCAACTTCACCCATTGTCAAGAG<br>CTTCAACAGGAATGAGTGTTAG | 980 |
| SM1B259 | pDR000030249 | ATGGAGACACATTCTCAGGTCTTTGTATACA<br>TGTTGCTGTGGTTGTCTGGTGTCGAGGGCCA<br>GATCGTGCTGACCCAGAGCCCTGCCATCAT<br>GTCTGCCAGCCCTGGCGAGAAAGTGACCAT<br>GACCTGTAGCGCCAGCAGCAGCGTGTCCTA<br>CATGTACTGGTATCAGCAGAAGCCCGGCAG<br>CAGCCCCAGACTGCTGATCTACGACACCAG<br>CAACCTGGCCAGCGGCGTGCCAGTGCGGTT<br>TTCTGGCAGCGGCAGCGGAACCAGCTACAG<br>CCTGACCATCAGCCGGATGGAAGCCGAGGA<br>CGCCGCCACCTACTACTGCCAGCAGTGGTCC<br>AGCTACCCTCCCACCTTTGGCGGAGGCACC<br>AAGCTGGAAATCAAGCGGGCTGATGCTGCA<br>CCGACTGTGTCCATCTTCCCACCATCCAGTG<br>AGCAGTTAACATCTGGAGGTGCCTCAGTCG<br>TGTGCTTCTTGAACAACTTCTACCCCAAAGA<br>CATCAATGTCAAGTGGAAGATTGATGGCAG<br>TGAACGACAAAATGGCGTCCTGAACAGTTG<br>GACTGATCAGGACAGCAAAGACAGCACCTA<br>CAGCATGAGCAGCACCCTCACGTTGACCAA<br>GGACGAGTATAACGACATAACAGCTATAC<br>CTGTGAGGCCACTCACAAGACATCAACTTC<br>ACCCATTGTCAAGAGCTTCAACAGGAATGA<br>GTGTTAG | 981 |

TABLE 29-continued

LukAB Antibody Light Chain Primary Transcripts

| mAB/ Fab name | Construct ID | Light Chain Primary Transcript | SEQ ID NO: |
|---|---|---|---|
| SM1B260 | pDR000030236 | ATGGAGACACATTCTCAGGTCTTTGTATACA TGTTGCTGTGGTTGTCTGGTGTCGAGGGCGA CATCGTGCTGACACAGTCTCCAGCCAGCCTG GCCGTGTCTCTGGGACAGAGGGCCACCATG AGCTGCAGAGCCAGCGAGTCTGTGGACGGC TACGGCAACAGCTTCCTGCACTGGTATCAGC AGAAGCCCGGCCAGCCTCCCAAGCTGCTGA TCTACAGGGCCAGCAACCTGGAAAGCGGCA TCCCCGCCAGATTCAGCGGCACCGGCAGCA GAACCGACTTCACCCTGACCATCACCCCTGT GGAAGCCGACGACGTGGCCACCTACTACTG CCAGCAGAGCAACGGCGACCCCTTCACCTT CGGCTCCGGCACCAAGCTGGAAATCAAGCG GGCTGATGCTGCACCGACTGTGTCCATCTTC CCACCATCCAGTGAGCAGTTAACATCTGGA GGTGCCTCAGTCGTGTGCTTCTTGAACAACT TCTACCCCAAAGACATCAATGTCAAGTGGA AGATTGATGGCAGTGAACGACAAAATGGCG TCCTGAACAGTTGGACTGATCAGGACAGCA AAGACAGCACCTACAGCATGAGCAGCACCC TCACGTTGACCAAGGACGAGTATGAACGAC ATAACAGCTATACCTGTGAGGCCACTCACA AGACATCAACTTCACCCATTGTCAAGAGCTT CAACAGGAATGAGTGTTAG | 982 |
| SM1B261 | pDR000030250 | ATGGAGACACATTCTCAGGTCTTTGTATACA TGTTGCTGTGGTTGTCTGGTGTCGAGGGCAA CATCGTGATGACCCAGAGCCCCAAGAGCAT GAGCATGTCCGTGGGCGAGAGAGTGACCCT GAGCTGCAAGGCCAGCGAGAACGTGGGCAC CTACGTGTCCTGGTATCAGCAGAAGCCCGA GCAGAGCCCTAAGCTGCTGATCTACGGGGC CAGCAACAGATACACCGGCGTGCCCGAGAG ATTCACAGGCAGCGGCAGCGCCACCGACTT CACCCTGACAATCAGCAGCGTGCAGGCCGA GGACCTGGCCGATTACCACTGTGGCCAGAG CTACAGCTACCCTCTGACCTTCGGAGCCGGC ACCAAGCTGGAACTGAAGCGGGCTGATGCT GCACCGACTGTGTCCATCTTCCCACCATCCA GTGAGCAGTTAACATCTGGAGGTGCCTCAG TCGTGTGCTTCTTGAACAACTTCTACCCCAA AGACATCAATGTCAAGTGGAAGATTGATGG CAGTGAACGACAAAATGGCGTCCTGAACAG TTGGACTGATCAGGACAGCAAAGACAGCAC CTACAGCATGAGCAGCACCCTCACGTTGAC CAAGGACGAGTATGAACGACATAACAGCTA TACCTGTGAGGCCACTCACAAGACATCAAC TTCACCCATTGTCAAGAGCTTCAACAGGAAT GAGTGTTAG | 983 |
| SM1B262 | pDR000030251 | ATGGAGACACATTCTCAGGTCTTTGTATACA TGTTGCTGTGGTTGTCTGGTGTCGAGGGCGA CATCAAGATGACCCAGAGCCCCAGCTCTAT GTACGCCAGCCTGGGCGAGCGCGTGACCAT CACCTGTAAAGCCAGCCAGGACATCAACAG CTACCTGAGCTGGTTCCAGCAGAAGCCCGG CAAGAGCCCCAAGACCCTGATCTACCGGGC CAACAGACTGGTGGACGGCGTGCCAAGCAG ATTCAGCGGCTCTGGCAGCGGCCAGGACTA CAGCCTGACCATCAGCAGCCTGGAATACGA GGACATGGGCATCTACTACTGCCTGCAGTA CGACGAGTTCCCTCTGACCTTCGGAGCCGGC ACCAAGCTGGAACTGAAGCGGGCTGATGCT GCACCGACTGTGTCCATCTTCCCACCATCCA GTGAGCAGTTAACATCTGGAGGTGCCTCAG TCGTGTGCTTCTTGAACAACTTCTACCCCAA AGACATCAATGTCAAGTGGAAGATTGATGG CAGTGAACGACAAAATGGCGTCCTGAACAG TTGGACTGATCAGGACAGCAAAGACAGCAC CTACAGCATGAGCAGCACCCTCACGTTGAC CAAGGACGAGTATGAACGACATAACAGCTA TACCTGTGAGGCCACTCACAAGACATCAAC | 984 |

TABLE 29-continued

LukAB Antibody Light Chain Primary Transcripts

| mAB/<br>Fab name | Con-<br>struct ID | Light Chain Primary Transcript | SEQ ID NO: |
|---|---|---|---|
| | | TTCACCCATTGTCAAGAGCTTCAACAGGAAT<br>GAGTGTTAG | |
| SM1B263 | pDR000030<br>252 | ATGGAGACACATTCTCAGGTCTTTGTATACA<br>TGTTGCTGTGGTTGTCTGGTGTCGAGGGCGA<br>CATCCAGATGACCCAGAGCCCTAGCAGCCT<br>GTCTGCCAGCCTGGGCGGCAAAGTGACCAT<br>CACATGCAAGGCCAGCCAGGACATCAACAA<br>GTATATCGCCTGGTATCAGCACAAGCCCGG<br>CAAGGGCCCCAGACTGCTGATCCACTACAC<br>CAGCACCCTGCAGCCCGGCATCCCTAGCAG<br>ATTTTCTGGCAGCGGCTCCGGCAGAGACTA<br>CAGCTTCAGCATCAGCAACCTGGAACCCGA<br>GGATATCGCCACCTACTACTGCCTGCAGTAC<br>GACAACCTGTGGACCTTCGGCGGAGGCACC<br>AAGGTGGAAATCAAGCGGGCTGATGCTGCA<br>CCGACTGTGTCCATCTTCCCACCATCCAGTG<br>AGCAGTTAACATCTGGAGGTGCCTCAGTCG<br>TGTGCTTCTTGAACAACTTCTACCCCAAAGA<br>CATCAATGTCAAGTGGAAGATTGATGGCAG<br>TGAACGACAAAATGGCGTCCTGAACAGTTG<br>GACTGATCAGGACAGCAAAGACAGCACCTA<br>CAGCATGAGCAGCACCCTCACGTTGACCAA<br>GGACGAGTATGAACGACATAACAGCTATAC<br>CTGTGAGGCCACTCACAAGACATCAACTTC<br>ACCCATTGTCAAGAGCTTCAACAGGAATGA<br>GTGTTAG | 985 |
| SM1B264 | pDR000030<br>253 | ATGGAGACACATTCTCAGGTCTTTGTATACA<br>TGTTGCTGTGGTTGTCTGGTGTCGAGGGCGA<br>CATCCAGATGACCCAGAGCCCTGCCAGCCT<br>GAGCGCCTCTGTGGGCGAGACAGTGACCAT<br>CATCTGCCGGGCCAGCGAGAACATCTACAG<br>CAACCTGGCCTGGTATCAGCAGAAGCAGGG<br>CAAGAGCCCTCAGCTGCTGGTGTACGCCGC<br>CACCAATCTGGCCGACGGCATGCCTAGCAG<br>ATTCAGCGGCTCTGGCAGCGGCACCCAGTA<br>CAGCCTGAAGATCAACAGCCTGCAGAGCGA<br>GGACTTCGGCAGCTACTACTGCCAGCACTTC<br>TGGGGCACCCCTTGGACCTTTGGCGGAGGC<br>ACCAAGCTGGAAATCAAGCGGGCTGATGCT<br>GCACCGACTGTGTCCATCTTCCCACCATCCA<br>GTGAGCAGTTAACATCTGGAGGTGCCTCAG<br>TCGTGTGCTTCTTGAACAACTTCTACCCCAA<br>AGACATCAATGTCAAGTGGAAGATTGATGG<br>CAGTGAACGACAAAATGGCGTCCTGAACAG<br>TTGGACTGATCAGGACAGCAAAGACAGCAC<br>CTACAGCATGAGCAGCACCCTCACGTTGAC<br>CAAGGACGAGTATGAACGACATAACAGCTA<br>TACCTGTGAGGCCACTCACAAGACATCAAC<br>TTCACCCATTGTCAAGAGCTTCAACAGGAAT<br>GAGTGTTAG | 986 |
| SM1B265 | pDR000030<br>254 | ATGGAGACACATTCTCAGGTCTTTGTATACA<br>TGTTGCTGTGGTTGTCTGGTGTCGAGGGCGA<br>CATCCAGATGACCCAGAGCCCTGCCAGCCT<br>GAGCGCCTCTGTGGGCGAGACAGTGACCAT<br>CATCTGCCGGGCCAGCGAGAACATCTACAG<br>CTACCTGGCCTGGTATCAGCAGAAGCAGGG<br>CAAGAGCCCTCAGCTGCTGTTCTACAACGCC<br>AAGACCCTGGTGGAAGGCGTGCCCAGCAGA<br>TTTTCTGGCTCTGGCAGCGGCACCCAGTTCA<br>GCCTGAAGATCAACAGCCTGCAGCCCGAGG<br>ACTTCGGCAGCTACTACTGCCAGCACCACTA<br>CGGCAGCCCCTACACCTTTGGCGGAGGCAC<br>CAAGCTGGAACTGAAGCGGGCTGATGCTGC<br>ACCGACTGTGTCCATCTTCCCACCATCCAGT<br>GAGCAGTTAACATCTGGAGGTGCCTCAGTC<br>GTGTGCTTCTTGAACAACTTCTACCCCAAAG<br>ACATCAATGTCAAGTGGAAGATTGATGGCA<br>GTGAACGACAAAATGGCGTCCTGAACAGTT<br>GGACTGATCAGGACAGCAAAGACAGCACCT | 987 |

TABLE 29-continued

LukAB Antibody Light Chain Primary Transcripts

| mAB/Fab name | Construct ID | Light Chain Primary Transcript | SEQ ID NO: |
|---|---|---|---|
| | | ACAGCATGAGCAGCACCCTCACGTTGACCA<br>AGGACGAGTATGAACGACATAACAGCTATA<br>CCTGTGAGGCCACTCACAAGACATCAACTT<br>CACCCATTGTCAAGAGCTTCAACAGGAATG<br>AGTGTTAG | |
| SM1B266 | pDR000030255 | ATGGAGACACATTCTCAGGTCTTTGTATACA<br>TGTTGCTGTGGTTGTCTGGTGTCGAGGGCGA<br>CATCCAGATGACCCAGAGCCCTAGCACACT<br>GAGCGCCAGCCTGGGCGACACCATCACCAT<br>CACATGCCACGCCAGCCAGAACATCAACGT<br>GTGGCTGAGCTGGTATCAGCAGAAGCCCGG<br>CAACATCCCCAAGCTGCTGATCTACAAGGC<br>CAGCAACCTGCACACCGGCGTGCCCAGCAG<br>ATTTTCTGGCAGCGGCTCTGGCACCGGCTTC<br>ACCCTGACAATCAGCAGCCTGCAGCCCGAG<br>GATATCGCCACCTACTACTGCCAGCAGGGC<br>CAGAGCTACCCTCTGACCTTTGGCGCTGGCA<br>CCAAGGTGGAAATCAAGCGGGCTGATGCTG<br>CACCGACTGTGTCCATCTTCCCACCATCCAG<br>TGAGCAGTTAACATCTGGAGGTGCCTCAGT<br>CGTGTGCTTCTTGAACAACTTCTACCCCAAA<br>GACATCAATGTCAAGTGGAAGATTGATGGC<br>AGTGAACGACAAAATGGCGTCCTGAACAGT<br>TGGACTGATCAGGACAGCAAAGACAGCACC<br>TACAGCATGAGCAGCACCCTCACGTTGACC<br>AAGGACGAGTATGAACGACATAACAGCTAT<br>ACCTGTGAGGCCACTCACAAGACATCAACT<br>TCACCCATTGTCAAGAGCTTCAACAGGAAT<br>GAGTGTTAG | 988 |
| SM1B267 | pDR000030256 | ATGGAGACACATTCTCAGGTCTTTGTATACA<br>TGTTGCTGTGGTTGTCTGGTGTCGAGGGCGA<br>CATCCAGATGACCCAGAGCCCTAGCACACT<br>GAGCGCCAGCCTGGGCGACACCATCACCAT<br>CACATGCCACGCCAGCCAGAACATCAACGT<br>GTGGCTGAGCTGGTATCAGCAGAAGCCCGG<br>CAACATCCCCAAGCTGCTGATCTACAAGGC<br>CAGCAACCTGCACACCGGCGTGCCCAGCAG<br>ATTTTCTGGCAGCGGCTCTGGCACCGGCTTC<br>ACCCTGACAATCAGCAGCCTGCAGCCCGAG<br>GATATCGCCACCTACTACTGCCAGCAGGGC<br>CAGAGCTACCCCTACACCTTTGGCGGAGGC<br>ACCAAGCTGGAAATCAAGCGGGCTGATGCT<br>GCACCGACTGTGTCCATCTTCCCACCATCCA<br>GTGAGCAGTTAACATCTGGAGGTGCCTCAG<br>TCGTGTGCTTCTTGAACAACTTCTACCCCAA<br>AGACATCAATGTCAAGTGGAAGATTGATGG<br>CAGTGAACGACAAAATGGCGTCCTGAACAG<br>TTGGACTGATCAGGACAGCAAAGACAGCAC<br>CTACAGCATGAGCAGCACCCTCACGTTGAC<br>CAAGGACGAGTATGAACGACATAACAGCTA<br>TACCTGTGAGGCCACTCACAAGACATCAAC<br>TTCACCCATTGTCAAGAGCTTCAACAGGAAT<br>GAGTGTTAG | 989 |
| SM1B268 | pDR000030257 | ATGGAGACACATTCTCAGGTCTTTGTATACA<br>TGTTGCTGTGGTTGTCTGGTGTCGAGGGCGA<br>GATCGTGCTGACCCAGAGCCCTACCACAAT<br>GGCCGCCAGCCCTGGCGAGAAGATCACCAT<br>CACATGCAGCGCCAGCAGCAGCATCAGCAG<br>CAACTACCTGCACTGGTATCAGCAGAAGCC<br>CGGCTTCAGCCCCAAGCTGCTGATCTACAG<br>AACCAGCAACCTGGCCAGCGGCGTGCCAGC<br>CAGATTTTCTGGCAGCGGCTCTGGCACCAGC<br>TACAGCCTGACCATCGGCACCATGGAAGCC<br>GAGGACGTGGCCACCTACTACTGCCAGCAG<br>GGCAGCTCCATCCCCAGAACCTTTGGCGGA<br>GGCACCAAGCTGGAAATCAAGCGGGCTGAT<br>GCTGCACCGACTGTGTCCATCTTCCCACCAT<br>CCAGTGAGCAGTTAACATCTGGAGGTGCCT<br>CAGTCGTGTGCTTCTTGAACAACTTCTACCC | 990 |

TABLE 29-continued

LukAB Antibody Light Chain Primary Transcripts

| mAB/Fab name | Construct ID | Light Chain Primary Transcript | SEQ ID NO: |
|---|---|---|---|
| | | CAAAGACATCAATGTCAAGTGGAAGATTGA<br>TGGCAGTGAACGACAAAATGGCGTCCTGAA<br>CAGTTGGACTGATCAGGACAGCAAAGACAG<br>CACCTACAGCATGAGCAGCACCCTCACGTT<br>GACCAAGGACGAGTATGAACGACATAACAG<br>CTATACCTGTGAGGCCACTCACAAGACATC<br>AACTTCACCCATTGTCAAGAGCTTCAACAG<br>GAATGAGTGTTAG | |
| SM1B269 | pDR000030<br>258 | ATGGAGACACATTCTCAGGTCTTTGTATACA<br>TGTTGCTGTGGTTGTCTGGTGTCGAGGGCGA<br>CATCGTGCTGACACAGTCTCCAGCCAGCCTG<br>GCCGTGTCTCTGGGACAGAGAGCCACCATC<br>AGCTGCAAGGCCAGCCAGAGCGTGGACTAC<br>GACGGCGACAGCTACATGAACTGGTATCAG<br>CAGAAGCCCGGCCAGCCTCCCAAGCTGCTG<br>ATCTACGCCGCCAGCAACCTGGAAAGCGGC<br>ATCCCTGCCAGATTCAGCGGCAGCGGCTCT<br>GGCACCGACTTCACCCTGAACATCCACCCC<br>GTGGAAGAAGAGGACGCCGCCACCTACTAC<br>TGCCAGCAGAGCAACGAGGACCCCTACACC<br>TTCGGCGGAGGCACCAAGCTGGAAATCAAG<br>CGGGCTGATGCTGCACCGACTGTGTCCATCT<br>TCCCACCATCCAGTGAGCAGTTAACATCTGG<br>AGGTGCCTCAGTCGTGTGCTTCTTGAACAAC<br>TTCTACCCCAAAGACATCAATGTCAAGTGG<br>AAGATTGATGGCAGTGAACGACAAAATGGC<br>GTCCTGAACAGTTGGACTGATCAGGACAGC<br>AAAGACAGCACCTACAGCATGAGCAGCACC<br>CTCACGTTGACCAAGGACGAGTATGAACGA<br>CATAACAGCTATACCTGTGAGGCCACTCAC<br>AAGACATCAACTTCACCCATTGTCAAGAGC<br>TTCAACAGGAATGAGTGTTAG | 991 |
| SM1B270 | pDR000030<br>259 | ATGGAGACACATTCTCAGGTCTTTGTATACA<br>TGTTGCTGTGGTTGTCTGGTGTCGAGGGCGA<br>CATCGTGCTGACACAGTCTCCAGCCAGCCTG<br>GCCGTGTCTCTGGGACAGAGAGCCAGCATC<br>AGCTGCAAGGCCAGCCAGAGCGTGGACTAC<br>GACGGCGACAGCTACATGAACTGGTATCAG<br>CAGAAGCCCGGCCAGCCTCCCAAGCTGCTG<br>ATCTACGCCGCCAGCAACCTGGAAAGCGGC<br>ATCCCTGCCAGATTCAGCGGCAGCGGCTCT<br>GGCACCGACTTCACCCTGAACATCCACCCC<br>GTGGAAGAAGAGGACGCCGCCACCTACTAC<br>TGCCAGCAGAGCTACGAGGACCCCTTCACC<br>TTCGGCTCCGGCACCAAGCTGGAAATCAAG<br>CGGGCTGATGCTGCACCGACTGTGTCCATCT<br>TCCCACCATCCAGTGAGCAGTTAACATCTGG<br>AGGTGCCTCAGTCGTGTGCTTCTTGAACAAC<br>TTCTACCCCAAAGACATCAATGTCAAGTGG<br>AAGATTGATGGCAGTGAACGACAAAATGGC<br>GTCCTGAACAGTTGGACTGATCAGGACAGC<br>AAAGACAGCACCTACAGCATGAGCAGCACC<br>CTCACGTTGACCAAGGACGAGTATGAACGA<br>CATAACAGCTATACCTGTGAGGCCACTCAC<br>AAGACATCAACTTCACCCATTGTCAAGAGC<br>TTCAACAGGAATGAGTGTTAG | 992 |
| SM1B271 | pDR000030<br>249 | ATGGAGACACATTCTCAGGTCTTTGTATACA<br>TGTTGCTGTGGTTGTCTGGTGTCGAGGGCCA<br>GATCGTGCTGACCCAGAGCCCTGCCATCAT<br>GTCTGCCAGCCCTGGCGAGAAAGTGACCAT<br>GACCTGTAGCGCCAGCAGCAGCGTGTCCTA<br>CATGTACTGGTATCAGCAGAAGCCCGGCAG<br>CAGCCCCAGACTGCTGATCTACGACACCAG<br>CAACCTGGCCAGCGGCGTGCCAGTGCGGTT<br>TTCTGGCAGCGGCAGCGGAACCAGCTACAG<br>CCTGACCATCAGCCGGATGGAAGCCGAGGA<br>CGCCGCCACCTACTACTGCCAGCAGTGGTCC<br>AGCTACCCTCCCACCTTTGGCGGAGGCACC<br>AAGCTGGAAATCAAGCGGGCTGATGCTGCA | 993 |

TABLE 29-continued

LukAB Antibody Light Chain Primary Transcripts

| mAB/Fab name | Construct ID | Light Chain Primary Transcript | SEQ ID NO: |
|---|---|---|---|
| | | CCGACTGTGTCCATCTTCCCACCATCCAGTG AGCAGTTAACATCTGGAGGTGCCTCAGTCG TGTGCTTCTTGAACAACTTCTACCCCAAAGA CATCAATGTCAAGTGGAAGATTGATGGCAG TGAACGACAAAATGGCGTCCTGAACAGTTG GACTGATCAGGACAGCAAAGACAGCACCTA CAGCATGAGCAGCACCCTCACGTTGACCAA GGACGAGTATGAACGACATAACAGCTATAC CTGTGAGGCCACTCACAAGACATCAACTTC ACCCATTGTCAAGAGCTTCAACAGGAATGA GTGTTAG | |
| SM1B272 | pDR000030260 | ATGGAGACACATTCTCAGGTCTTTGTATACA TGTTGCTGTGGTTGTCTGGTGTCGAGGGCGA CATCGTGATGACCCAGAGCCAGAAATTCAT GAGCACCAGCGTGGGCGACCGGGTGTCCGT GACATGCAAGGCCAGCCAGAACGTGGGCAC CAACGTGGCCTGGTATCAGCAGAAGCCCGG CCAGAGCCCCAAGGCCCTGATCTACAGCGC CAGCTACAGATACAGCGGCGTGCCCGACAG ATTCACAGGCAGCGGCTCTGGCACCGACTT CACCCTGACCATCAGCAACGTGCAGAGCGA GGACCTGGCCGAGTACTTCTGCCAGCAGTA CAACAGCTACCCCTTCACCTTCGGCAGCGGC ACCAAGCTGGAAATCAAGCGGGCTGATGCT GCACCGACTGTGTCCATCTTCCCACCATCCA GTGAGCAGTTAACATCTGGAGGTGCCTCAG TCGTGTGCTTCTTGAACAACTTCTACCCCAA AGACATCAATGTCAAGTGGAAGATTGATGG CAGTGAACGACAAAATGGCGTCCTGAACAG TTGGACTGATCAGGACAGCAAAGACAGCAC CTACAGCATGAGCAGCACCCTCACGTTGAC CAAGGACGAGTATGAACGACATAACAGCTA TACCTGTGAGGCCACTCACAAGACATCAAC TTCACCCATTGTCAAGAGCTTCAACAGGAAT GAGTGTTAG | 994 |
| SM1B273 | pDR000030261 | ATGGAGACACATTCTCAGGTCTTTGTATACA TGTTGCTGTGGTTGTCTGGTGTCGAGGGCGA CATCGTGATGAGCCAGAGCCCTAGCAGCCT GGCCGTGTCCGTGGGCGAGAAAGTGACCAT GAGCTGCAAGAGCAGCCAGTCCCTGCTGTA CTCCAGCAACCAGAAGAACTACCTGGCCTG GTATCAGCAGAAGCCCGGCCAGTCCCCTAA GCTGCTGATCTACTGGGCCAGCACCAGAGA AAGCGGCGTGCCCGATAGATTCACAGGCAG CGGCTCCGGCACCGACTTCACCCTGACAATC AGCAGCGTGAAGGCCGAGGACCTGCTGTG TACTACTGCCAGCAGTACTACAGCTACCCCT ACACCTTCGGCGGAGGCACCAAGCTGGAAA TCAAGCGGGCTGATGCTGCACCGACTGTGT CCATCTTCCCACCATCCAGTGAGCAGTTAAC ATCTGGAGGTGCCTCAGTCGTGTGCTTCTTG AACAACTTCTACCCCAAAGACATCAATGTC AAGTGGAAGATTGATGGCAGTGAACGACAA AATGGCGTCCTGAACAGTTGGACTGATCAG GACAGCAAAGACAGCACCTACAGCATGAGC AGCACCCTCACGTTGACCAAGGACGAGTAT GAACGACATAACAGCTATACCTGTGAGGCC ACTCACAAGACATCAACTTCACCCATTGTCA AGAGCTTCAACAGGAATGAGTGTTAG | 995 |
| SM1B274 | pDR000030262 | ATGGAGACACATTCTCAGGTCTTTGTATACA TGTTGCTGTGGTTGTCTGGTGTCGAGGGCGA CGTCGTGATGACCCAGACACCCCTGAGCCT GCCTGTGTCTCTGGGCGATCAGGCCAGCATC AGCTGCAGATCCAGCCAGAGCCTGGTGCAC AGCAACGGCAACACCTACCTGCACTGGTAT CTGCAGAAGCCCGGCCAGAGCCCCAAGCTG CTGATCTACAAGGTGTCCAACAGATTCAGC GGCGTGCCCGACAGATTCTCTGGCAGCGGC TCTGGCACCGACTTCACCCTGAAGATCAGCC | 996 |

TABLE 29-continued

LukAB Antibody Light Chain Primary Transcripts

| mAB/Fab name | Construct ID | Light Chain Primary Transcript | SEQ ID NO: |
|---|---|---|---|
| | | GGGTGGAAGCCGAGGACCTGGGCGTGTACT<br>TCTGCAGCCAGTCCACCCACGTGCCACCCTA<br>CACCTTTGGCGGAGGCACCAAGCTGGAACT<br>GAAGCGGGCTGATGCTGCACCGACTGTGTC<br>CATCTTCCCACCATCCAGTGAGCAGTTAACA<br>TCTGGAGGTGCCTCAGTCGTGTGCTTCTTGA<br>ACAACTTCTACCCCAAAGACATCAATGTCA<br>AGTGGAAGATTGATGGCAGTGAACGACAAA<br>ATGGCGTCCTGAACAGTTGGACTGATCAGG<br>ACAGCAAAGACAGCACCTACAGCATGAGCA<br>GCACCCTCACGTTGACCAAGGACGAGTATG<br>AACGACATAACAGCTATACCTGTGAGGCCA<br>CTCACAAGACATCAACTTCACCCATTGTCAA<br>GAGCTTCAACAGGAATGAGTGTTAG | |
| SM1B275 | pDR000030263 | ATGGAGACACATTCTCAGGTCTTTGTATACA<br>TGTTGCTGTGGTTGTCTGGTGTCGAGGGCGA<br>CGTCGTGATGACCCAGACCCCTCTGACCCTG<br>AGCGTGACAATCGGCCAGCCTGCCAGCATC<br>AGCTGCAAGAGCAGCCAGAGCCTGCTGTAC<br>TCCAACGGCAAGACCTACCTGAACTGGCTG<br>CTGCAGAGGCCTGGCCAGAGCCCCAAGAGA<br>CTGATCTACCTGGTGTCCAAGCTGGACAGC<br>GGCGTGCCCGATAGATTCACAGGCAGCGGC<br>TCCGGCACCGACTTCACCCTGAAGATCAGC<br>CGGGTGGAAGCCGAGGACCTGGGCGTGTTC<br>TACTGTGTGCAGGGCACCCACTTCCCTCAGA<br>CCTTCGGCGGAGGCACAAAGCTGGAACTGA<br>AGCGGGCTGATGCTGCACCGACTGTGTCCA<br>TCTTCCCACCATCCAGTGAGCAGTTAACATC<br>TGGAGGTGCCTCAGTCGTGTGCTTCTTGAAC<br>AACTTCTACCCCAAAGACATCAATGTCAAG<br>TGGAAGATTGATGGCAGTGAACGACAAAAT<br>GGCGTCCTGAACAGTTGGACTGATCAGGAC<br>AGCAAAGACAGCACCTACAGCATGAGCAGC<br>ACCCTCACGTTGACCAAGGACGAGTATGAA<br>CGACATAACAGCTATACCTGTGAGGCCACT<br>CACAAGACATCAACTTCACCCATTGTCAAG<br>AGCTTCAACAGGAATGAGTGTTAG | 997 |

TABLE 30

LukE Antibody Heavy Chain CDSs

| mAB/Fab name | Construct ID | Heavy Chain CDS | SEQ ID NO: |
|---|---|---|---|
| SM1B208 | pDR000027280 | GAGGTTCAGCTGCAGCAGTCTGGGGGAGGC<br>TCAGTGCAGCCTGGAGGGTCCCGGAAACTC<br>TCCTGTGCAGCCTCTGGATTCACCTTCAGTA<br>GTTTTGGAATGCACTGGGTTCGTCAGGCTCC<br>AGAGAAGGGGCTGGAGTGGGTCGCATACAT<br>TAGTAGTGGCAGTAGTTTCATCTACTATGGA<br>GACACAGTGAAGGGCCGATTCACCATCTCC<br>AGAGACAATCCCAATAACACCCTGTTCCTG<br>CAAATGACCAGTCTAAGGTCTGAGGACACG<br>GCCATATATTACTGTGCAAGAGAAGGAATT<br>TATTTCTACGATAGTAGGTACTTCGATGTCT<br>GGGGCGCAGGGACCACGGTCACCGTCTCCT<br>CAGCCAAAACGACACCCCCATCTGTCTATCC<br>ACTGGCCCCTGGATCTGCTGCCCAAACTAAC<br>TCCATGGTGACCCTGGGATGCCTGGTCAAG<br>GCTATTTCCCTGAGCCAGTGACAGTGACCT<br>GGAACTCTGGATCCCTGTCCAGCGGTGTGC<br>ACACCTTCCCAGCTGTCCTGGAGTCTGACCT<br>CTACACTCTGAGCAGCTCAGTGACTGTCCCC<br>TCCAGCCCTCGGCCCAGCGAGACCGTCACC<br>TGCAACGTTGCCCACCCGGCCAGCAGCACC<br>AAGGTGGACAAGAAAATTGTGCCCAGGGAT<br>TGTGGTTGTAAGCCTTGCATATGTACAGTCC<br>CAGAAGTATCATCTGTCTTCATCTTCCCCCC<br>AAAGCCCAAGGATGTGCTCACCATTACTCT | 998 |

TABLE 30-continued

LukE Antibody Heavy Chain CDSs

| mAB/Fab name | Construct ID | Heavy Chain CDS | SEQ ID NO: |
|---|---|---|---|
| | | GACTCCTAAGGTCACGTGTGTTGTGGTAGAC<br>ATCAGCAAGGATGATCCCGAGGTCCAGTTC<br>AGCTGGTTTGTAGATGATGTGGAGGTGCAC<br>ACAGCTCAGACGCAACCCCGGGAGGAGCAG<br>TTCAACAGCACTTTCCGCTCAGTCAGTGAAC<br>TTCCCATCATGCACCAGGACTGGCTCAATGG<br>CAAGGAGTTCAAATGCAGGGTCAACAGTGC<br>AGCTTTCCCTGCCCCCATCGAGAAAACCATC<br>TCCAAAACCAAAGGCAGACCGAAGGCTCCA<br>CAGGTGTACACCATTCCACCTCCCAAGGAG<br>CAGATGGCCAAGGATAAAGTCAGTCTGACC<br>TGCATGATAACAGACTTCTTCCCTGAAGACA<br>TTACTGTGGAGTGGCAGTGGAATGGGCAGC<br>CAGCGGAGAACTACAAGAACACTCAGCCCA<br>TCATGAACACGAATGGCTCTTACTTCGTCTA<br>CAGCAAGCTCAATGTGCAGAAGAGCAACTG<br>GGAGGCAGGAAATACTTTCACCTGCTCTGT<br>GTTACATGAGGGCCTGCACAACCACCATAC<br>TGAGAAGAGCCTCTCCCACTCTCCTGGTAAA | |
| SM1B209 | pDR000027280 | GAGGTTCAGCTGCAGCAGTCTGGGGGAGGC<br>TCAGTGCAGCCTGGAGGGTCCCGGAAACTC<br>TCCTGTGCAGCCTCTGGATTCACCTTCAGTA<br>GTTTTGGAATGCACTGGGTTCGTCAGGCTCC<br>AGAGAAGGGGCTGGAGTGGGTCGCATACAT<br>TAGTAGTGGCAGTAGTTTCATCTACTATGGA<br>GACACAGTGAAGGGCCGATTCACCATCTCC<br>AGAGACAATCCCAATAACACCCTGTTCCTG<br>CAAATGACCAGTCTAAGGTCTGAGGACACG<br>GCCATATATTACTGTGCAAGAGAAGGAATT<br>TATTTCTACGATAGTAGGTACTTCGATGTCT<br>GGGGCGCAGGGACCACGGTCACCGTCTCCT<br>CAGCCAAAACGACACCCCCATCTGTCTATCC<br>ACTGGCCCCTGGATCTGCTGCCCAAACTAAC<br>TCCATGGTGACCCTGGGATGCCTGGTCAAG<br>GGCTATTTCCCTGAGCCAGTGACAGTGACCT<br>GGAACTCTGGATCCCTGTCCAGCGGTGTGC<br>ACACCTTCCCAGCTGTCCTGGAGTCTGACCT<br>CTACACTCTGAGCAGCTCAGTGACTGTCCCC<br>TCCAGCCCTCGGCCCAGCGAGACCGTCACC<br>TGCAACGTTGCCCACCCGGCCAGCAGCACC<br>AAGGTGGACAAGAAAATTGTGCCCAGGGAT<br>TGTGGTTGTAAGCCTTGCATATGTACAGTCC<br>CAGAAGTATCATCTGTCTTCATCTTCCCCCC<br>AAAGCCCAAGGATGTGCTCACCATTACTCT<br>GACTCCTAAGGTCACGTGTGTTGTGGTAGAC<br>ATCAGCAAGGATGATCCCGAGGTCCAGTTC<br>AGCTGGTTTGTAGATGATGTGGAGGTGCAC<br>ACAGCTCAGACGCAACCCCGGGAGGAGCAG<br>TTCAACAGCACTTTCCGCTCAGTCAGTGAAC<br>TTCCCATCATGCACCAGGACTGGCTCAATGG<br>CAAGGAGTTCAAATGCAGGGTCAACAGTGC<br>AGCTTTCCCTGCCCCCATCGAGAAAACCATC<br>TCCAAAACCAAAGGCAGACCGAAGGCTCCA<br>CAGGTGTACACCATTCCACCTCCCAAGGAG<br>CAGATGGCCAAGGATAAAGTCAGTCTGACC<br>TGCATGATAACAGACTTCTTCCCTGAAGACA<br>TTACTGTGGAGTGGCAGTGGAATGGGCAGC<br>CAGCGGAGAACTACAAGAACACTCAGCCCA<br>TCATGAACACGAATGGCTCTTACTTCGTCTA<br>CAGCAAGCTCAATGTGCAGAAGAGCAACTG<br>GGAGGCAGGAAATACTTTCACCTGCTCTGT<br>GTTACATGAGGGCCTGCACAACCACCATAC<br>TGAGAAGAGCCTCTCCCACTCTCCTGGTAAA | 999 |
| SM1B210 | pDR000027281 | GATGTACAGCTTCAGGAGTCAGGACCTGGG<br>CACTCCATGGTGACCCTGGGATGCCTGGTTG<br>GGCAAAGTATACAGGCCGAGTTCCAGCTGC<br>AGCAGTCTGGACCTGAACTAGTGAAGACTG<br>GGGCTTCAGTGAAGATATCCTGCAAGGCTT<br>CTGGTTACTCTTTCACTGGTTACTACATGCA<br>CTGGGTCAAGCAGAGCCATGGAAGGAGCCT<br>TGAGTGGATTGGATATCTTAGTTGTTACAGT<br>GGTGCTACTAGCTACAACCAGAAGTTCAAG<br>GGCAAGGCCACATTTACTGTAGACACATCC | 1000 |

TABLE 30-continued

LukE Antibody Heavy Chain CDSs

| mAB/Fab name | Construct ID | Heavy Chain CDS | SEQ ID NO: |
|---|---|---|---|
| | | TCCACCACAGCCTACATGCAGTTCAACAGC<br>CTGACATCTGAAGACTCTGCGGTCTATTACT<br>GTGCACGAGGGGAGAGCTACTATGTTATGG<br>ACTATTGGGGTCAAGGAACCTCAGTCACCG<br>TCTCCTCAGCCAAAACGACACCCCCATCTGT<br>CTATCCACTGGCCCCTGGATCTGCTGCCCAA<br>ACTAACTCCATGGTGACCCTGGGATGCCTG<br>GTCAAGGGCTATTTCCCTGAGCCAGTGACA<br>GTGACCTGGAACTCTGGATCCCTGTCCAGCG<br>GTGTGCACACCTTCCCAGCTGTCCTGGAGTC<br>TGACCTCTACACTCTGAGCAGCTCAGTGACT<br>GTCCCCTCCAGCCCTCGGCCCAGCGAGACC<br>GTCACCTGCAACGTTGCCCACCCGGCCAGC<br>AGCACCAAGGTGGACAAGAAAATTGTGCCC<br>AGGGATTGTGGTTGTAAGCCTTGCATATGTA<br>CAGTCCCAGAAGTATCATCTGTCTTCATCTT<br>CCCCCCAAAGCCCAAGGATGTGCTCACCAT<br>TACTCTGACTCCTAAGGTCACGTGTGTTGTG<br>GTAGACATCAGCAAGGATGATCCCGAGGTC<br>CAGTTCAGCTGGTTTGTAGATGATGTGGAG<br>GTGCACACAGCTCAGACGCAACCCCGGGAG<br>GAGCAGTTCAACAGCACTTTCCGCTCAGTCA<br>GTGAACTTCCCATCATGCACCAGGACTGGCT<br>CAATGGCAAGGAGTTCAAATGCAGGGTCAA<br>CAGTGCAGCTTTCCCTGCCCCCATCGAGAAA<br>ACCATCTCCAAAACCAAAGGCAGACCGAAG<br>GCTCCACAGGTGTACACCATTCCACCTCCCA<br>AGGAGCAGATGGCCAAGGATAAAGTCAGTC<br>TGACCTGCATGATAACAGACTTCTTCCCTGA<br>AGACATTACTGTGGAGTGGCAGTGGAATGG<br>GCAGCCAGCGGAGAACTACAAGAACACTCA<br>GCCCATCATGAACACGAATGGCTCTTACTTC<br>GTCTACAGCAAGCTCAATGTGCAGAAGAGC<br>AACTGGGAGGCAGGAAATACTTTCACCTGC<br>TCTGTGTTACATGAGGGCCTGCACAACCACC<br>ATACTGAGAAGAGCCTCTCCCACTCTCCTGG<br>TAAA | |
| SM1B211 | pDR000027282 | GAGGTTCAGCTGCAGCAGTCTGGACCTGGC<br>CTGGTGAAGCCTTCTCAGACAGTGTCCCTCA<br>CCTGCACTGTCACTGGCTACTCTATCACTAA<br>TGGTAATCACTGGTGGAACTGGATCCGGCA<br>GGTTTCAGGAAGCAAACTGGAGTGGATAGG<br>GTACATAAGCTCCAGTGGTAGCACTGACAG<br>CAATCCATCTCTCAAAAGTCGAATCTCCATC<br>ACTAGAGACACTTCCAAGAACCAGTTATTC<br>CTGCAGTTGAACTCTGTGACTACTGAAGATA<br>TAGCCACATATTACTGTGCAAGAGGGCATT<br>ACTACGATGGTAGCTCCTATGCTATGGACTA<br>CTGGGGTCAAGGAACCTCAGTCACCGTCTC<br>CTCAGCCAAAACAACAGCCCCATCGGTCTA<br>TCCACTGGCCCCTGTGTGTGGAGATACAAGT<br>GACTCCATGGTGACCCTGGGATGCCTGGTC<br>AAGGGCTATTTCCCTGAGCCAGTGACAGTG<br>ACCTGGAACTCTGGATCCCTGTCCAGCGGTG<br>TGCACACCTTCCCAGCTGTCCTGGAGTCTGA<br>CCTCTACACTCTGAGCAGCTCAGTGACTGTC<br>CCCTCCAGCCCTCGGCCCAGCGAGACCGTC<br>ACCTGCAACGTTGCCCACCCGGCCAGCAGC<br>ACCAAGGTGGACAAGAAAATTGTGCCCAGG<br>GATTGTGGTTGTAAGCCTTGCATATGTACAG<br>TCCCAGAAGTATCATCTGTCTTCATCTTCCC<br>CCCAAAGCCCAAGGATGTGCTCACCATTAC<br>TCTGACTCCTAAGGTCACGTGTGTTGTGGTA<br>GACATCAGCAAGGATGATCCCGAGGTCCAG<br>TTCAGCTGGTTTGTAGATGATGTGGAGGTGC<br>ACACAGCTCAGACGCAACCCCGGGAGGAGC<br>AGTTCAACAGCACTTTCCGCTCAGTCAGTGA<br>ACTTCCCATCATGCACCAGGACTGGCTCAAT<br>GGCAAGGAGTTCAAATGCAGGGTCAACAGT<br>GCAGCTTTCCCTGCCCCCATCGAGAAAACC<br>ATCTCCAAAACCAAAGGCAGACCGAAGGCT<br>CCACAGGTGTACACCATTCCACCTCCCAAG<br>GAGCAGATGGCCAAGGATAAAGTCAGTCTG<br>ACCTGCATGATAACAGACTTCTTCCCTGAAG | 1001 |

TABLE 30-continued

LukE Antibody Heavy Chain CDSs

| mAB/Fab name | Construct ID | Heavy Chain CDS | SEQ ID NO: |
|---|---|---|---|
| | | ACATTACTGTGGAGTGGCAGTGGAATGGGC AGCCAGCGGAGAACTACAAGAACACTCAGC CCATCATGAACACGAATGGCTCTTACTTCGT CTACAGCAAGCTCAATGTGCAGAAGAGCAA CTGGGAGGCAGGAAATACTTTCACCTGCTCT GTGTTACATGAGGGCCTGCACAACCACCAT ACTGAGAAGAGCCTCTCCCACTCTCCTGGTA AA | |
| SM1B507 | pDR000034825 | GAGGTTCAGCTGCAGCAGTCTGGGGCTGAG CTGGTGAAGCCTGGGGCTTCAGTGAAGATG TCCTGTAAGGCTTCTGGATACACATTCACTG ACTACTACATGGACTGGGTGAAGCAGAGCC ATGGAAAAGCTTTGAGTGGATTGGACATG TTAATCCTTACAATGGTGATACTAGGTACAA CCAGAAGTTCAAGGGCAAGGCCACATTGAC TGTTGACAAGTCCTCCACCACAGCCTACATG GAGCTCAACAGCCTGACATCTGAGGACTCT GCGGTCTATTACTGTGCAAGAGGGAACTTCT TTGACTACTGGGGCCAAGGCACCACTCTCTC AGTCCTCAGCCAAAACGACACCCCCATCT GTCTATCCACTGGCCCCTGGATCTGCTGCCC AAACTAACTCCATGGTGACCCTGGGATGCC TGGTCAAGGGCTATTTCCCTGAGCCAGTGAC AGTGACCTGGAACTCTGGATCCCTGTCCAGC GGTGTGCACACCTTCCCAGCTGTCCTGGAGT CTGACCTCTACACTCTGAGCAGCTCAGTGAC TGTCCCCTCCAGCCCTCGGCCCAGCGAGACC GTCACCTGCAACGTTGCCCACCCGGCCAGC AGCACCAAGGTGGACAAGAAAATTGTGCCC AGGGATTGTGGTTGTAAGCCTTGCATATGTA CAGTCCCAGAAGTATCATCTGTCTTCATCTT CCCCCCAAAGCCCAAGGATGTGCTCACCAT TACTCTGACTCCTAAGGTCACGTGTGTTGTG GTAGACATCAGCAAGGATGATCCCGAGGTC CAGTTCAGCTGGTTTGTAGATGATGTGGAG GTGCACACAGCTCAGACGCAACCCCGGGAG GAGCAGTTCAACAGCACTTTCCGCTCAGTCA GTGAACTTCCCATCATGCACCAGGACTGGCT CAATGGCAAGGAGTTCAAATGCAGGGTCAA CAGTGCAGCTTTCCCTGCCCCATCGAGAAA ACCATCTCCAAAACCAAAGGCAGACCGAAG GCTCCACAGGTGTACACCATTCCACCTCCCA AGGAGCAGATGGCCAAGGATAAAGTCAGTC TGACCTGCATGATAACAGACTTCTTCCCTGA AGACATTACTGTGGAGTGGCAGTGGAATGG GCAGCCAGCGGAGAACTACAAGAACACTCA GCCCATCATGAACACGAATGGCTCTTACTTC GTCTACAGCAAGCTCAATGTGCAGAAGAGC AACTGGGAGGCAGGAAATACTTTCACCTGC TCTGTGTTACATGAGGGCCTGCACAACCACC ATACTGAGAAGAGCCTCTCCCACTCTCCTGG TAAA | 1002 |
| SM1B508 | pDR000034826 | GAGGTTCAGCTGCAGCAGTCTGGGGCTGAG CTGGTGAAGCCTGGGGCTTCAGTGAAGATA TCCTGCAAGACTTCTGGTTACTCATTTACTG GCTACTTTATGAATTGGGTGATGCAGAGCC ATGGAAAGAGCCTTGAGTGGATTGGACGTA TTAATCCTTACAATGGTGATACTTTCTACAA CCAGAAGTTCAAGGGCAAGGCCACATTGAC TGTAGACAAATCCTCTAGCACAGCCCACAT GGAGCTCCGGAGCCTGGCATCTGAGGACTC TGCAGTCTATTATTGTGCAAGAAGCTACGGC TATGCTATGGACTACTGGGGTCAAGGAACC TCAGTCACCGTCTCCTCAGCCAAAACGACA CCCCCATCTGTCTATCCACTGGCCCCTGGAT CTGCTGCCCAAACTAACTCCATGGTGACCCT GGGATGCCTGGTCAAGGGCTATTTCCCTGA GCCAGTGACAGTGACCTGGAACTCTGGATC CCTGTCCAGCGGTGTGCACACCTTCCCAGCT GTCCTGGAGTCTGACCTCTACACTCTGAGCA GCTCAGTGACTGTCCCCTCCAGCCCTCGGCC CAGCGAGACCGTCACCTGCAACGTTGCCCA CCCGGCCAGCAGCACCAAGGTGGACAAGAA | 1003 |

TABLE 30-continued

LukE Antibody Heavy Chain CDSs

| mAB/Fab name | Construct ID | Heavy Chain CDS | SEQ ID NO: |
|---|---|---|---|
| | | AATTGTGCCCAGGGATTGTGGTTGTAAGCCT TGCATATGTACAGTCCCAGAAGTATCATCTG TCTTCATCTTCCCCCCAAAGCCCAAGGATGT GCTCACCATTACTCTGACTCCTAAGGTCACG TGTGTTGTGGTAGACATCAGCAAGGATGAT CCCGAGGTCCAGTTCAGCTGGTTTGTAGATG ATGTGGAGGTGCACACAGCTCAGACGCAAC CCCGGGAGGAGCAGTTCAACAGCACTTTCC GCTCAGTCAGTGAACTTCCCATCATGCACCA GGACTGGCTCAATGGCAAGGAGTTCAAATG CAGGGTCAACAGTGCAGCTTTCCCTGCCCCC ATCGAGAAACCATCTCCAAAACCAAAGGC AGACCGAAGGCTCCACAGGTGTACACCATT CCACCTCCCAAGGAGCAGATGGCCAAGGAT AAAGTCAGTCTGACCTGCATGATAACAGAC TTCTTCCCTGAAGACATTACTGTGGAGTGGC AGTGGAATGGGCAGCCAGCGGAGAACTACA AGAACACTCAGCCCATCATGAACACGAATG GCTCTTACTTCGTCTACAGCAAGCTCAATGT GCAGAAGAGCAACTGGGAGGCAGGAAATA CTTTCACCTGCTCTGTGTTACATGAGGGCCT GCACAACCACCATACTGAGAAGAGCCTCTC CCACTCTCCTGGTAAA | |
| SM1B509 | pDR000034827 | CAGGTGCAGCTGAAGGAGTCAGGACCTGGC CTGGTGGCGCCCTCACAGAGCCTGTCCATCA CATGCACCGTCTCAGGGTTCTCATTAACCGG CTATGGTGTAAACTGGGTTCGCCAGCCTCCA GGAAAGGGTCTGGAGTGGCTGGGGTTGATG TGGGGTGATGGAAGCACAGACTATAATTCA GCTCTCAACTCCAGACTGCGCATCAACAAG GACAACTCCAAGAGTCAAGTTTTCTTAAAA ATGAGCAGTCTCAAACTGATGACACAGCC ATTTACTACTGTGTCAGAAAGGCGGTAAT AGCCCCTATGCTATGGACTACTGGGGTCAA GGAACCTCAGTCACCGTCTCCTCAGCCAAA ACGACACCCCCATCTGTCTATCCACTGGCCC CTGGATCTGCTGCCCAAACTAACTCCATGGT GACCCTGGGATGCCTGGTCAAGGGCTATTTC CCTGAGCCAGTGACAGTGACCTGGAACTCT GGATCCCTGTCCAGCGGTGTGCACACCTTCC CAGCTGTCCTGGAGTCTGACCTCTACACTCT GAGCAGCTCAGTGACTGTCCCCTCCAGCCCT CGGCCCAGCGAGACCGTCACCTGCAACGTT GCCCACCCGGCCAGCAGCACCAAGGTGGAC AAGAAAATTGTGCCCAGGGATTGTGGTTGT AAGCCTTGCATATGTACAGTCCCAGAAGTA TCATCTGTCTTCATCTTCCCCCCAAAGCCCA AGGATGTGCTCACCATTACTCTGACTCCTAA GGTCACGTGTGTTGTGGTAGACATCAGCAA GGATGATCCCGAGGTCCAGTTCAGCTGGTTT GTAGATGATGTGGAGGTGCACACAGCTCAG ACGCAACCCCGGGAGGAGCAGTTCAACAGC ACTTTCCGCTCAGTCAGTGAACTTCCCATCA TGCACCAGGACTGGCTCAATGGCAAGGAGT TCAAATGCAGGGTCAACAGTGCAGCTTTCC CTGCCCCCATCGAGAAAACCATCTCCAAAA CCAAAGGCAGACCGAAGGCTCCACAGGTGT ACACCATTCCACCTCCCAAGGAGCAGATGG CCAAGGATAAAGTCAGTCTGACCTGCATGA TAACAGACTTCTTCCCTGAAGACATTACTGT GGAGTGGCAGTGGAATGGGCAGCCAGCGGA GAACTACAAGAACACTCAGCCCATCATGAA CACGAATGGCTCTTACTTCGTCTACAGCAAG CTCAATGTGCAGAAGAGCAACTGGGAGGCA GGAAATACTTTCACCTGCTCTGTGTTACATG AGGGCCTGCACAACCACCATACTGAGAAGA GCCTCTCCCACTCTCCTGGTAAA | 1004 |
| SM1B510 | pDR000034827 | CAGGTGCAGCTGAAGGAGTCAGGACCTGGC CTGGTGGCGCCCTCACAGAGCCTGTCCATCA CATGCACCGTCTCAGGGTTCTCATTAACCGG CTATGGTGTAAACTGGGTTCGCCAGCCTCCA GGAAAGGGTCTGGAGTGGCTGGGGTTGATG TGGGGTGATGGAAGCACAGACTATAATTCA | 1005 |

TABLE 30-continued

LukE Antibody Heavy Chain CDSs

| mAB/Fab name | Construct ID | Heavy Chain CDS | SEQ ID NO: |
|---|---|---|---|
| | | GCTCTCAACTCCAGACTGCGCATCAACAAG GACAACTCCAAGAGTCAAGTTTTCTTAAAA ATGAGCAGTCTTCAAACTGATGACACAGCC ATTTACTACTGTGTCAGAAAGGGCGGTAAT AGCCCCTATGCTATGGACTACTGGGGTCAA GGAACCTCAGTCACCGTCTCCTCAGCCAAA ACGACACCCCCATCTGTCTATCCACTGGCCC CTGGATCTGCTGCCCAAACTAACTCCATGGT GACCCTGGGATGCCTGGTCAAGGGCTATTTC CCTGAGCCAGTGACAGTGACCTGGAACTCT GGATCCCTGTCCAGCGGTGTGCACACCTTCC CAGCTGTCCTGGAGTCTGACCTCTACACTCT GAGCAGCTCAGTGACTGTCCCCTCCAGCCCT CGGCCCAGCGAGACCGTCACCTGCAACGTT GCCCACCCGGCCAGCAGCACCAAGGTGGAC AAGAAAATTGTGCCCAGGGATTGTGGTTGT AAGCCTTGCATATGTACAGTCCCAGAAGTA TCATCTGTCTTCATCTTCCCCCCAAAGCCCA AGGATGTGCTCACCATTACTCTGACTCCTAA GGTCACGTGTGTTGTGGTAGACATCAGCAA GGATGATCCCGAGGTCCAGTTCAGCTGGTTT GTAGATGATGTGGAGGTGCACACAGCTCAG ACGCAACCCCGGGAGGAGCAGTTCAACAGC ACTTTCCGCTCAGTCAGTGAACTTCCCATCA TGCACCAGGACTGGCTCAATGGCAAGGAGT TCAAATGCAGGGTCAACAGTGCAGCTTTCC CTGCCCCCATCGAGAAAACCATCTCCAAAA CCAAAGGCAGACCGAAGGCTCCACAGGTGT ACACCATTCCACCTCCCAAGGAGCAGATGG CCAAGGATAAAGTCAGTCTGACCTGCATGA TAACAGACTTCTTCCCTGAAGACATTACTGT GGAGTGGCAGTGGAATGGGCAGCCAGCGGA GAACTACAAGAACACTCAGCCCATCATGAA CACGAATGGCTCTTACTTCGTCTACAGCAAG CTCAATGTGCAGAAGAGCAACTGGGAGGCA GGAAATACTTTCACCTGCTCTGTGTTACATG AGGGCCTGCACAACCACCTACTGAGAAGA GCCTCTCCCACTCTCCTGGTAAA | |
| SM1B511 | pDR000034830 | GAAGTGAAGCTGGTGGAGTCTGGGCCTGAG CTGGTGAAGCCTGGGGCTTCAGTGAAGATA TCCTGCAAGACTTCTGGTTACTCATTTACTG GCTACTTTATGAATTGGGTGATGCAGAGCC ATGGAAAGAGCCTTGAGTGGATTGGACGTA TTAATCCTTACAATGGTGATACTTTCTACAA CCAGAAGTTCAAGGGCAAGGCCACATTGAC TGTAGACAAATCCTCTAGCACAGCCCACAT GGAGCTCCGGAGCCTGGCATCTGAGGACTC TGCAGTCTATTATTGTGCAAGAAGCTACGGC TATGCTATGGACTACTGGGGTCAAGGAACC TCAGTCACCGTCTCCTCAGCCAAAACGACA CCCCCATCTGTCTATCCACTGGCCCCTGGAT CTGCTGCCCAAACTAACTCCATGGTGACCCT GGGATGCCTGGTCAAGGGCTATTTCCCTGA GCCAGTGACAGTGACCTGGAACTCTGGATC CCTGTCCAGCGGTGTGCACACCTTCCCAGCT GTCCTGGAGTCTGACCTCTACACTCTGAGCA GCTCAGTGACTGTCCCCTCCAGCCCTCGGCC CAGCGAGACCGTCACCTGCAACGTTGCCCA CCCGGCCAGCAGCACCAAGGTGGACAAGAA AATTGTGCCCAGGGATTGTGGTTGTAAGCCT TGCATATGTACAGTCCCAGAAGTATCATCTG TCTTCATCTTCCCCCCAAAGCCCAAGGATGT GCTCACCATTACTCTGACTCCTAAGGTCACG TGTGTTGTGGTAGACATCAGCAAGGATGAT CCCGAGGTCCAGTTCAGCTGGTTTGTAGATG ATGTGGAGGTGCACACAGCTCAGACGCAAC CCCGGGAGGAGCAGTTCAACAGCACTTTCC GCTCAGTCAGTGAACTTCCCATCATGCACCA GGACTGGCTCAATGGCAAGGAGTTCAAATG CAGGGTCAACAGTGCAGCTTTCCCTGCCCCC ATCGAGAAAACCATCTCCAAAACCAAAGGC AGACCGAAGGCTCCACAGGTGTACACCATT CCACCTCCCAAGGAGCAGATGGCCAAGGAT AAAGTCAGTCTGACCTGCATGATAACAGAC | 1006 |

TABLE 30-continued

LukE Antibody Heavy Chain CDSs

| mAB/Fab name | Construct ID | Heavy Chain CDS | SEQ ID NO: |
|---|---|---|---|
| | | TTCTTCCCTGAAGACATTACTGTGGAGTGGC AGTGGAATGGGCAGCCAGCGGAGAACTACA AGAACACTCAGCCCATCATGAACACGAATG GCTCTTACTTCGTCTACAGCAAGCTCAATGT GCAGAAGAGCAACTGGGAGGCAGGAAATA CTTTCACCTGCTCTGTGTTACATGAGGGCCT GCACAACCACCATACTGAGAAGAGCCTCTC CCACTCTCCTGGTAAA | |
| SM1B512 | pDR000034830 | GAAGTGAAGCTGGTGGAGTCTGGGCCTGAG CTGGTGAAGCCTGGGGCTTCAGTGAAGATA TCCTGCAAGACTTCTGGTTACTCATTTACTG GCTACTTTATGAATTGGGTGATGCAGAGCC ATGGAAAGAGCCTTGAGTGGATTGGACGTA TTAATCCTTACAATGGTGATACTTTCTACAA CCAGAAGTTCAAGGGCAAGGCCACATTGAC TGTAGACAAATCCTCTAGCACAGCCCACAT GGAGCTCCGGAGCCTGGCATCTGAGGACTC TGCAGTCTATTATTGTGCAAGAAGCTACGGC TATGCTATGGACTACTGGGGTCAAGGAACC TCAGTCACCGTCTCCTCAGCCAAAACGACA CCCCCATCTGTCTATCCACTGGCCCCTGGAT CTGCTGCCCAAACTAACTCCATGGTGACCCT GGGATGCCTGGTCAAGGGCTATTTCCCTGA GCCAGTGACAGTGACCTGGAACTCTGGATC CCTGTCCAGCGGTGTGCACACCTTCCCAGCT GTCCTGGAGTCTGACCTCTACACTCTGAGCA GCTCAGTGACTGTCCCCTCCAGCCCTCGGCC CAGCGAGACCGTCACCTGCAACGTTGCCCA CCCGGCCAGCAGCACCAAGGTGGACAAGAA AATTGTGCCCAGGGATTGTGGTTGTAAGCCT TGCATATGTACAGTCCCAGAAGTATCATCTG TCTTCATCTTCCCCCCAAAGCCCAAGGATGT GCTCACCATTACTCTGACTCCTAAGGTCACG TGTGTTGTGGTAGACATCAGCAAGGATGAT CCCGAGGTCCAGTTCAGCTGGTTTGTAGATG ATGTGGAGGTGCACACAGCTCAGACGCAAC CCCGGGAGGAGCAGTTCAACAGCACTTTCC GCTCAGTCAGTGAACTTCCCATCATGCACCA GGACTGGCTCAATGGCAAGGAGTTCAAATG CAGGGTCAACAGTGCAGCTTTCCCTGCCCCC ATCGAGAAAACCATCTCCAAAACCAAAGGC AGACCGAAGGCTCCACAGGTGTACACCATT CCACCTCCCAAGGAGCAGATGGCCAAGGAT AAAGTCAGTCTGACCTGCATGATAACAGAC TTCTTCCCTGAAGACATTACTGTGGAGTGGC AGTGGAATGGGCAGCCAGCGGAGAACTACA AGAACACTCAGCCCATCATGAACACGAATG GCTCTTACTTCGTCTACAGCAAGCTCAATGT GCAGAAGAGCAACTGGGAGGCAGGAAATA CTTTCACCTGCTCTGTGTTACATGAGGGCCT GCACAACCACCATACTGAGAAGAGCCTCTC CCACTCTCCTGGTAAA | 1007 |
| SM1B513 | pDR000034831 | GAGGTTCAGCTGCAGCAGTCTGGACCTGAG CTGGTGAAGCCTGGGGCTTCAGTGAAGATA TCCTGCAAGGCTTCTGGTTACTCATTTACTG GCTACTTTATGAATTGGGTGATGCAGAGCC ATGGAAAGAGCCTTGAGTGGATTGGACGTA TTAATCCTTACAATGGTGATACTTTCTACAA CCAGAAATTCAAGGGCAAGGCCACATTGAC TGTAGACAAATCCTCTAACACAGCCCACAT GGAGCTCCGGAGCCTGGCATCTGAGGACTC TGCAGTCTATTTTTGTGCAAGAAGTTACGGC TATGCTATGGACTACTGGGGTCTAGGAACCT CAGTCACCGTCTCCTCAGCCAAAACGACAC CCCCATCTGTCTATCCACTGGCCCCTGGATC TGCTGCCCAAACTAACTCCATGGTGACCCTG GGATGCCTGGTCAAGGGCTATTTCCCTGAGC CAGTGACAGTGACCTGGAACTCTGGATCCC TGTCCAGCGGTGTGCACACCTTCCCAGCTGT CCTGGAGTCTGACCTCTACACTCTGAGCAGC TCAGTGACTGTCCCCTCCAGCCCTCGGCCCA GCGAGACCGTCACCTGCAACGTTGCCCACC CGGCCAGCAGCACCAAGGTGGACAAGAAA | 1008 |

TABLE 30-continued

LukE Antibody Heavy Chain CDSs

| mAB/Fab name | Construct ID | Heavy Chain CDS | SEQ ID NO: |
|---|---|---|---|
| | | ATTGTGCCCAGGGATTGTGGTTGTAAGCCTT<br>GCATATGTACAGTCCCAGAAGTATCATCTGT<br>CTTCATCTTCCCCCCAAAGCCCAAGGATGTG<br>CTCACCATTACTCTGACTCCTAAGGTCACGT<br>GTGTTGTGGTAGACATCAGCAAGGATGATC<br>CCGAGGTCCAGTTCAGCTGGTTTGTAGATGA<br>TGTGGAGGTGCACACAGCTCAGACGCAACC<br>CCGGGAGGAGCAGTTCAACAGCACTTTCCG<br>CTCAGTCAGTGAACTTCCCATCATGCACCAG<br>GACTGGCTCAATGGCAAGGAGTTCAAATGC<br>AGGGTCAACAGTGCAGCTTTCCCTGCCCCCA<br>TCGAGAAAACCATCTCCAAAACCAAAGGCA<br>GACCGAAGGCTCCACAGGTGTACACCATTC<br>CACCTCCCAAGGAGCAGATGGCCAAGGATA<br>AAGTCAGTCTGACCTGCATGATAACAGACT<br>TCTTCCCTGAAGACATTACTGTGGAGTGGCA<br>GTGGAATGGGCAGCCAGCGGAGAACTACAA<br>GAACACTCAGCCCATCATGAACACGAATGG<br>CTCTTACTTCGTCTACAGCAAGCTCAATGTG<br>CAGAAGAGCAACTGGGAGGCAGGAAATACT<br>TTCACCTGCTCTGTGTTACATGAGGGCCTGC<br>ACAACCACCATACTGAGAAGAGCCTCTCCC<br>ACTCTCCTGGTAAA | |
| SM1B514 | pDR000034833 | GAGGTTCAGCTGCAGCAGTCTGGGCCTGAA<br>CTAGTGAAGACTGGGGCTTCAGTGAAGATA<br>TCCTGCAAGGCTTCTGGTTACTCTTTCACTG<br>GTTACTACATGCACTGGGTCAAGCAGAGCC<br>ATGGAAAGAGCCTTGAGTGGATTGGATATC<br>TTAGTTGTTACAGTGGTGCTACTAGCTACAA<br>CCAGAAGTTCAAGGGCAAGGCCACATTTAC<br>TGTAGACACATCCTCCACCACAGCCTACATG<br>CAGTTCAACAGCCTGACATCTGAAGACTCT<br>GCGGTCTATTACTGTGCACGAGGGGAGAGC<br>TACTATGTTATGGACTATTGGGGTCAAGGA<br>ACCTCAGTCACCGTCTCCTCAGCCAAAACG<br>ACACCCCCATCTGTCTATCCACTGGCCCCTG<br>GATCTGCTGCCCAAACTAACTCCATGGTGAC<br>CCTGGGATGCCTGGTCAAGGGCTATTTCCCT<br>GAGCCAGTGACAGTGACCTGGAACTCTGGA<br>TCCCTGTCCAGCGGTGTGCACACCTTCCCAG<br>CTGTCCTGGAGTCTGACCTCTACACTCTGAG<br>CAGCTCAGTGACTGTCCCCTCCAGCCCTCGG<br>CCCAGCGAGACCGTCACCTGCAACGTTGCC<br>CACCCGGCCAGCAGCACCAAGGTGGACAAG<br>AAAATTGTGCCCAGGGATTGTGGTTGTAAG<br>CCTTGCATATGTACAGTCCCAGAAGTATCAT<br>CTGTCTTCATCTTCCCCCCAAAGCCCAAGGA<br>TGTGCTCACCATTACTCTGACTCCTAAGGTC<br>ACGTGTGTTGTGGTAGACATCAGCAAGGAT<br>GATCCCGAGGTCCAGTTCAGCTGGTTTGTAG<br>ATGATGTGGAGGTGCACACAGCTCAGACGC<br>AACCCCGGGAGGAGCAGTTCAACAGCACTT<br>TCCGCTCAGTCAGTGAACTTCCCATCATGCA<br>CCAGGACTGGCTCAATGGCAAGGAGTTCAA<br>ATGCAGGGTCAACAGTGCAGCTTTCCCTGCC<br>CCCATCGAGAAAACCATCTCCAAAACCAAA<br>GGCAGACCGAAGGCTCCACAGGTGTACACC<br>ATTCCACCTCCCAAGGAGCAGATGGCCAAG<br>GATAAAGTCAGTCTGACCTGCATGATAACA<br>GACTTCTTCCCTGAAGACATTACTGTGGAGT<br>GGCAGTGGAATGGGCAGCCAGCGGAGAACT<br>ACAAGAACACTCAGCCCATCATGAACACGA<br>ATGGCTCTTACTTCGTCTACAGCAAGCTCAA<br>TGTGCAGAAGAGCAACTGGGAGGCAGGAA<br>ATACTTTCACCTGCTCTGTGTTACATGAGGG<br>CCTGCACAACCACCATACTGAGAAGAGCCT<br>CTCCCACTCTCCTGGTAAA | 1009 |

TABLE 31

LukE Antibody Heavy Chain Primary Transcripts

| mAB/Fab name | Construct ID | Heavy Chain Primary Transcript | SEQ ID NO: |
|---|---|---|---|
| SM1B208 | pDR000027280 | ATGGCTTGGGTGTGGACCTTGCTATTCCTGA TGGCAGCTGCCCAAAGTATACAGGCCGAGG TTCAGCTGCAGCAGTCTGGGGGAGGCTCAGT GCAGCCTGGAGGGTCCCGGAAACTCTCCTGT GCAGCCTCTGGATTCACCTTCAGTAGTTTTG GAATGCACTGGGTTCGTCAGGCTCCAGAGA AGGGGCTGGAGTGGGTCGCATACATTAGTA GTGGCAGTAGTTTCATCTACTATGGAGACAC AGTGAAGGGCCGATTCACCATCTCCAGAGA CAATCCCAATAACACCCTGTTCCTGCAAATG ACCAGTCTAAGGTCTGAGGACACGGCCATA TATTACTGTGCAAGAGAAGGAATTTATTTCT ACGATAGTAGGTACTTCGATGTCTGGGGCGC AGGGACCACGGTCACCGTCTCCTCAGCCAA AACGACACCCCCATCTGTCTATCCACTGGCC CCTGGATCTGCTGCCCAAACTAACTCCATGG TGACCCTGGGATGCCTGGTCAAGGGCTATTT CCCTGAGCCAGTGACAGTGACCTGGAACTCT GGATCCCTGTCCAGCGGTGTGCACACCTTCC CAGCTGTCCTGGAGTCTGACCTCTACACTCT GAGCAGCTCAGTGACTGTCCCCTCCAGCCCT CGGCCCAGCGAGACCGTCACCTGCAACGTT GCCCACCCGGCCAGCAGCACCAAGGTGGAC AAGAAAATTGTGCCCAGGGATTGTGGTTGTA AGCCTTGCATATGTACAGTCCCAGAAGTATC ATCTGTCTTCATCTTCCCCCCAAAGCCCAAG GATGTGCTCACCATTACTCTGACTCCTAAGG TCACGTGTGTTGTGGTAGACATCAGCAAGGA TGATCCCGAGGTCCAGTTCAGCTGGTTTGTA GATGATGTGGAGGTGCACACAGCTCAGACG CAACCCCGGGAGGAGCAGTTCAACAGCACT TTCCGCTCAGTCAGTGAACTTCCCATCATGC ACCAGGACTGGCTCAATGGCAAGGAGTTCA AATGCAGGGTCAACAGTGCAGCTTTCCCTGC CCCCATCGAGAAAACCATCTCCAAAACCAA AGGCAGACCGAAGGCTCCACAGGTGTACAC CATTCCACCTCCCAAGGAGCAGATGGCCAA GGATAAAGTCAGTCTGACCTGCATGATAAC AGACTTCTTCCCTGAAGACATTACTGTGGAG TGGCAGTGGAATGGGCAGCCAGCGGAGAAC TACAAGAACACTCAGCCCATCATGAACACG AATGGCTCTTACTTCGTCTACAGCAAGCTCA ATGTGCAGAAGAGCAACTGGGAGGCAGGAA ATACTTTCACCTGCTCTGTGTTACATGAGGG CCTGCACAACCACCATACTGAGAAGAGCCT CTCCCACTCTCCTGGTAAATGA | 1010 |
| SM1B209 | pDR000027280 | ATGGCTTGGGTGTGGACCTTGCTATTCCTGA TGGCAGCTGCCCAAAGTATACAGGCCGAGG TTCAGCTGCAGCAGTCTGGGGGAGGCTCAGT GCAGCCTGGAGGGTCCCGGAAACTCTCCTGT GCAGCCTCTGGATTCACCTTCAGTAGTTTTG GAATGCACTGGGTTCGTCAGGCTCCAGAGA AGGGGCTGGAGTGGGTCGCATACATTAGTA GTGGCAGTAGTTTCATCTACTATGGAGACAC AGTGAAGGGCCGATTCACCATCTCCAGAGA CAATCCCAATAACACCCTGTTCCTGCAAATG ACCAGTCTAAGGTCTGAGGACACGGCCATA TATTACTGTGCAAGAGAAGGAATTTATTTCT ACGATAGTAGGTACTTCGATGTCTGGGGCGC AGGGACCACGGTCACCGTCTCCTCAGCCAA AACGACACCCCCATCTGTCTATCCACTGGCC CCTGGATCTGCTGCCCAAACTAACTCCATGG TGACCCTGGGATGCCTGGTCAAGGGCTATTT CCCTGAGCCAGTGACAGTGACCTGGAACTCT GGATCCCTGTCCAGCGGTGTGCACACCTTCC CAGCTGTCCTGGAGTCTGACCTCTACACTCT GAGCAGCTCAGTGACTGTCCCCTCCAGCCCT CGGCCCAGCGAGACCGTCACCTGCAACGTT GCCCACCCGGCCAGCAGCACCAAGGTGGAC AAGAAAATTGTGCCCAGGGATTGTGGTTGTA AGCCTTGCATATGTACAGTCCCAGAAGTATC ATCTGTCTTCATCTTCCCCCCAAAGCCCAAG GATGTGCTCACCATTACTCTGACTCCTAAGG TCACGTGTGTTGTGGTAGACATCAGCAAGGA | 1011 |

TABLE 31-continued

LukE Antibody Heavy Chain Primary Transcripts

| mAB/Fab name | Construct ID | Heavy Chain Primary Transcript | SEQ ID NO: |
|---|---|---|---|
| | | TGATCCCGAGGTCCAGTTCAGCTGGTTTGTA<br>GATGATGTGGAGGTGCACACAGCTCAGACG<br>CAACCCCGGGAGGAGCAGTTCAACAGCACT<br>TTCCGCTCAGTCAGTGAACTTCCCATCATGC<br>ACCAGGACTGGCTCAATGGCAAGGAGTTCA<br>AATGCAGGGTCAACAGTGCAGCTTTCCCTGC<br>CCCCATCGAGAAAACCATCTCCAAAACCAA<br>AGGCAGACCGAAGGCTCCACAGGTGTACAC<br>CATTCCACCTCCCAAGGAGCAGATGGCCAA<br>GGATAAAGTCAGTCTGACCTGCATGATAAC<br>AGACTTCTTCCCTGAAGACATTACTGTGGAG<br>TGGCAGTGGAATGGGCAGCCAGCGGAGAAC<br>TACAAGAACACTCAGCCCATCATGAACACG<br>AATGGCTCTTACTTCGTCTACAGCAAGCTCA<br>ATGTGCAGAAGAGCAACTGGGAGGCAGGAA<br>ATACTTTCACCTGCTCTGTGTTACATGAGGG<br>CCTGCACAACCACCATACTGAGAAGAGCCT<br>CTCCCACTCTCCTGGTAAATGA | |
| SM1B210 | pDR000027281 | ATGGCTTGGGTGTGGACCTTGCTATTCCTGA<br>TGGCAGCTGCCCAAAGTATACAGGCCGATG<br>TACAGCTTCAGGAGTCAGGACCTGGGCACTC<br>CATGGTGACCCTGGGATGCCTGGTTGGGCAA<br>AGTATACAGGCCGAGTTCCAGCTGCAGCAG<br>TCTGGACCTGAACTAGTGAAGACTGGGGCTT<br>CAGTGAAGATATCCTGCAAGGCTTCTGGTTA<br>CTCTTTCACTGGTTACTACATGCACTGGGTC<br>AAGCAGAGCCATGGAAGGAGCCTTGAGTGG<br>ATTGGATATCTTAGTTGTTACAGTGGTGCTA<br>CTAGCTACAACCAGAAGTTCAAGGGCAAGG<br>CCACATTTACTGTAGACACATCCTCCACCAC<br>AGCCTACATGCAGTTCAACAGCCTGACATCT<br>GAAGACTCTGCGGTCTATTACTGTGCACGAG<br>GGGAGAGCTACTATGTTATGGACTATTGGGG<br>TCAAGGAACCTCAGTCACCGTCTCCTCAGCC<br>AAAACGACACCCCCATCTGTCTATCCACTGG<br>CCCCTGGATCTGCTGCCCAAACTAACTCCAT<br>GGTGACCCTGGGATGCCTGGTCAAGGGCTAT<br>TTCCCTGAGCCAGTGACAGTGACCTGGAACT<br>CTGGATCCCTGTCCAGCGGTGTGCACACCTT<br>CCCAGCTGTCCTGGAGTCTGACCTCTACACT<br>CTGAGCAGCTCAGTGACTGTCCCCTCCAGCC<br>CTCGGCCCAGCGAGACCGTCACCTGCAACGT<br>TGCCCACCCGGCCAGCAGCACCAAGGTGGA<br>CAAGAAAATTGTGCCCAGGGATTGTGGTTGT<br>AAGCCTTGCATATGTACAGTCCCAGAAGTAT<br>CATCTGTCTTCATCTTCCCCCCAAAGCCCAA<br>GGATGTGCTCACCATTACTCTGACTCCTAAG<br>GTCACGTGTGTTGTGGTAGACATCAGCAAGG<br>ATGATCCCGAGGTCCAGTTCAGCTGGTTTGT<br>AGATGATGTGGAGGTGCACACAGCTCAGAC<br>GCAACCCCGGGAGGAGCAGTTCAACAGCAC<br>TTTCCGCTCAGTCAGTGAACTTCCCATCATG<br>CACCAGGACTGGCTCAATGGCAAGGAGTTC<br>AAATGCAGGGTCAACAGTGCAGCTTTCCCTG<br>CCCCCATCGAGAAACCATCTCCAAAACCA<br>AAGGCAGACCGAAGGCTCCACAGGTGTACA<br>CCATTCCACCTCCCAAGGAGCAGATGGCCA<br>AGGATAAAGTCAGTCTGACCTGCATGATAA<br>CAGACTTCTTCCCTGAAGACATTACTGTGGA<br>GTGGCAGTGGAATGGGCAGCCAGCGGAGAA<br>CTACAAGAACACTCAGCCCATCATGAACAC<br>GAATGGCTCTTACTTCGTCTACAGCAAGCTC<br>AATGTGCAGAAGAGCAACTGGGAGGCAGGA<br>AATACTTTCACCTGCTCTGTGTTACATGAGG<br>GCCTGCACAACCACCATACTGAGAAGAGCC<br>TCTCCCACTCTCCTGGTAAATGA | 1012 |
| SM1B211 | pDR000027282 | ATGGCTTGGGTGTGGACCTTGCTATTCCTGA<br>TGGCAGCTGCCCAAAGTATACAGGCCGAGG<br>TTCAGCTGCAGCAGTCTGGACCTGGCCTGGT<br>GAAGCCTTCTCAGACAGTGTCCCTCACCTGC<br>ACTGTCACTGGCTACTCTATCACTAATGGTA<br>ATCACTGGTGGAACTGGATCCGGCAGGTTTC<br>AGGAAGCAAACTGGAGTGGATAGGGTACAT | 1013 |

TABLE 31-continued

LukE Antibody Heavy Chain Primary Transcripts

| mAB/Fab name | Construct ID | Heavy Chain Primary Transcript | SEQ ID NO: |
|---|---|---|---|
| | | AAGCTCCAGTGGTAGCACTGACAGCAATCC<br>ATCTCTCAAAAGTCGAATCTCCATCACTAGA<br>GACACTTCCAAGAACCAGTTATTCCTGCAGT<br>TGAACTCTGTGACTACTGAAGATATAGCCAC<br>ATATTACTGTGCAAGAGGGCATTACTACGAT<br>GGTAGCTCCTATGCTATGGACTACTGGGGTC<br>AAGGAACCTCAGTCACCGTCTCCTCAGCCAA<br>AACAACAGCCCCATCGGTCTATCCACTGGCC<br>CCTGTGTGTGGAGATACAAGTGACTCCATGG<br>TGACCCTGGGATGCCTGGTCAAGGGCTATTT<br>CCCTGAGCCAGTGACAGTGACCTGGAACTCT<br>GGATCCCTGTCCAGCGGTGTGCACACCTTCC<br>CAGCTGTCCTGGAGTCTGACCTCTACACTCT<br>GAGCAGCTCAGTGACTGTCCCCTCCAGCCCT<br>CGGCCCAGCGAGACCGTCACCTGCAACGTT<br>GCCCACCCGGCCAGCAGCACCAAGGTGGAC<br>AAGAAAATTGTGCCCAGGGATTGTGGTTGTA<br>AGCCTTGCATATGTACAGTCCCAGAAGTATC<br>ATCTGTCTTCATCTTCCCCCCAAAGCCCAAG<br>GATGTGCTCACCATTACTCTGACTCCTAAGG<br>TCACGTGTGTTGTGGTAGACATCAGCAAGGA<br>TGATCCCGAGGTCCAGTTCAGCTGGTTTGTA<br>GATGATGTGGAGGTGCACACAGCTCAGACG<br>CAACCCCGGGAGGAGCAGTTCAACAGCACT<br>TTCCGCTCAGTCAGTGAACTTCCCATCATGC<br>ACCAGGACTGGCTCAATGGCAAGGAGTTCA<br>AATGCAGGGTCAACAGTGCAGCTTTCCCTGC<br>CCCCATCGAGAAAACCATCTCCAAAACCAA<br>AGGCAGACCGAAGGCTCCACAGGTGTACAC<br>CATTCCACCTCCCAAGGAGCAGATGGCCAA<br>GGATAAAGTCAGTCTGACCTGCATGATAAC<br>AGACTTCTTCCCTGAAGACATTACTGTGGAG<br>TGGCAGTGGAATGGGCAGCCAGCGGAGAAC<br>TACAAGAACACTCAGCCCATCATGAACACG<br>AATGGCTCTTACTTCGTCTACAGCAAGCTCA<br>ATGTGCAGAAGAGCAACTGGGAGGCAGGAA<br>ATACTTTCACCTGCTCTGTGTTACATGAGGG<br>CCTGCACAACCACCATACTGAGAAGAGCCT<br>CTCCCACTCTCCTGGTAAATGA | |
| SM1B507 | pDR000034825 | ATGGCTTGGGTGTGGACCTTGCTATTCCTGA<br>TGGCAGCTGCCCAAAGTATACAGGCCGAGG<br>TTCAGCTGCAGCAGTCTGGGGCTGAGCTGGT<br>GAAGCCTGGGGCTTCAGTGAAGATGTCCTGT<br>AAGGCTTCTGGATACACATTCACTGACTACT<br>ACATGGACTGGGTGAAGCAGAGCCATGGAA<br>AAAGCTTTGAGTGGATTGGACATGTTAATCC<br>TTACAATGGTGATACTAGGTACAACCAGAA<br>GTTCAAGGGCAAGGCCACATTGACTGTTGAC<br>AAGTCCTCCACCACAGCCTACATGGAGCTCA<br>ACAGCCTGACATCTGAGGACTCTGCGGTCTA<br>TTACTGTGCAAGAGGGAACTTCTTTGACTAC<br>TGGGGCCAAGGCACCACTCTCTCAGTCTCCT<br>CAGCCAAAACGACACCCCCATCTGTCTATCC<br>ACTGGCCCCTGGATCTGCTGCCCAAACTAAC<br>TCCATGGTGACCCTGGGATGCCTGGTCAAGG<br>GCTATTTCCCTGAGCCAGTGACAGTGACCTG<br>GAACTCTGGATCCCTGTCCAGCGGTGTGCAC<br>ACCTTCCCAGCTGTCCTGGAGTCTGACCTCT<br>ACACTCTGAGCAGCTCAGTGACTGTCCCCTC<br>CAGCCCTCGGCCCAGCGAGACCGTCACCTGC<br>AACGTTGCCCACCCGGCCAGCAGCACCAAG<br>GTGGACAAGAAAATTGTGCCCAGGGATTGT<br>GGTTGTAAGCCTTGCATATGTACAGTCCCAG<br>AAGTATCATCTGTCTTCATCTTCCCCCCAAA<br>GCCCAAGGATGTGCTCACCATTACTCTGACT<br>CCTAAGGTCACGTGTGTTGTGGTAGACATCA<br>GCAAGGATGATCCCGAGGTCCAGTTCAGCT<br>GGTTTGTAGATGATGTGGAGGTGCACACAG<br>CTCAGACGCAACCCCGGGAGGAGCAGTTCA<br>ACAGCACTTTCCGCTCAGTCAGTGAACTTCC<br>CATCATGCACCAGGACTGGCTCAATGGCAA<br>GGAGTTCAAATGCAGGGTCAACAGTGCAGC<br>TTTCCCTGCCCCCATCGAGAAAACCATCTCC<br>AAAACCAAAGGCAGACCGAAGGCTCCACAG | 1014 |

TABLE 31-continued

LukE Antibody Heavy Chain Primary Transcripts

| mAB/Fab name | Construct ID | Heavy Chain Primary Transcript | SEQ ID NO: |
|---|---|---|---|
| | | GTGTACACCATTCCACCTCCCAAGGAGCAGA TGGCCAAGGATAAAGTCAGTCTGACCTGCAT GATAACAGACTTCTTCCCTGAAGACATTACT GTGGAGTGGCAGTGGAATGGGCAGCCAGCG GAGAACTACAAGAACACTCAGCCCATCATG AACACGAATGGCTCTTACTTCGTCTACAGCA AGCTCAATGTGCAGAAGAGCAACTGGGAGG CAGGAAATACTTTCACCTGCTCTGTGTTACA TGAGGGCCTGCACAACCACCATACTGAGAA GAGCCTCTCCCACTCTCCTGGTAAATGA | |
| SM1B508 | pDR000034826 | ATGGCTTGGGTGTGGACCTTGCTATTCCTGA TGGCAGCTGCCCAAAGTATACAGGCCGAGG TTCAGCTGCAGCAGTCTGGGGCTGAGCTGGT GAAGCCTGGGGCTTCAGTGAAGATATCCTGC AAGACTTCTGGTTACTCATTTACTGGCTACT TTATGAATTGGGTGATGCAGAGCCATGGAA AGAGCCTTGAGTGGATTGGACGTATTAATCC TTACAATGGTGATACTTTCTACAACCAGAAG TTCAAGGGCAAGGCCACATTGACTGTAGAC AAATCCTCTAGCACAGCCCACATGGAGCTCC GGAGCCTGGCATCTGAGGACTCTGCAGTCTA TTATTGTGCAAGAAGCTACGGCTATGCTATG GACTACTGGGGTCAAGGAACCTCAGTCACC GTCTCCTCAGCCAAAACGACACCCCCATCTG TCTATCCACTGGCCCCTGGATCTGCTGCCCA AACTAACTCCATGGTGACCCTGGGATGCCTG GTCAAGGGCTATTTCCCTGAGCCAGTGACAG TGACCTGGAACTCTGGATCCCTGTCCAGCGG TGTGCACACCTTCCCAGCTGTCCTGGAGTCT GACCTCTACACTCTGAGCAGCTCAGTGACTG TCCCCTCCAGCCCTCGGCCCAGCGAGACCGT CACCTGCAACGTTGCCCACCCGGCCAGCAGC ACCAAGGTGGACAAGAAAATTGTGCCCAGG GATTGTGGTTGTAAGCCTTGCATATGTACAG TCCCAGAAGTATCATCTGTCTTCATCTTCCCC CCAAAGCCCAAGGATGTGCTCACCATTACTC TGACTCCTAAGGTCACGTGTGTTGTGGTAGA CATCAGCAAGGATGATCCCGAGGTCCAGTTC AGCTGGTTTGTAGATGATGTGGAGGTGCACA CAGCTCAGACGCAACCCCGGGAGGAGCAGT TCAACAGCACTTTCCGCTCAGTCAGTGAACT TCCCATCATGCACCAGGACTGGCTCAATGGC AAGGAGTTCAAATGCAGGGTCAACAGTGCA GCTTTCCCTGCCCCCATCGAGAAAACCATCT CCAAAACCAAAGGCAGACCGAAGGCTCCAC AGGTGTACACCATTCCACCTCCCAAGGAGCA GATGGCCAAGGATAAAGTCAGTCTGACCTG CATGATAACAGACTTCTTCCCTGAAGACATT ACTGTGGAGTGGCAGTGGAATGGGCAGCCA GCGGAGAACTACAAGAACACTCAGCCCATC ATGAACACGAATGGCTCTTACTTCGTCTACA GCAAGCTCAATGTGCAGAAGAGCAACTGGG AGGCAGGAAATACTTTCACCTGCTCTGTGTT ACATGAGGGCCTGCACAACCACCATACTGA GAAGAGCCTCTCCCACTCTCCTGGTAAATGA | 1015 |
| SM1B509 | pDR000034827 | ATGGCTTGGGTGTGGACCTTGCTATTCCTGA TGGCAGCTGCCCAAAGTATACAGGCCCAGG TGCAGCTGAAGGAGTCAGGACCTGGCCTGG TGGCGCCCTCACAGAGCCTGTCCATCACATG CACCGTCTCAGGGTTCTCATTAACCGGCTAT GGTGTAAACTGGGTTCGCCAGCCTCCAGGA AAGGGTCTGGAGTGGCTGGGGTTGATGTGG GGTGATGGAAGCACAGACTATAATTCAGCT CTCAACTCCAGACTGCGCATCAACAAGGAC AACTCCAAGAGTCAAGTTTTCTTAAAAATGA GCAGTCTTCAAACTGATGACACAGCCATTTA CTACTGTGTCAGAAAGGGCGGTAATAGCCC CTATGCTATGGACTACTGGGGTCAAGGAACC TCAGTCACCGTCTCCTCAGCCAAAACGACAC CCCCATCTGTCTATCCACTGGCCCCTGGATC TGCTGCCCAAACTAACTCCATGGTGACCCTG GGATGCCTGGTCAAGGGCTATTTCCCTGAGC CAGTGACAGTGACCTGGAACTCTGGATCCCT | 1016 |

TABLE 31-continued

LukE Antibody Heavy Chain Primary Transcripts

| mAB/Fab name | Construct ID | Heavy Chain Primary Transcript | SEQ ID NO: |
|---|---|---|---|
| | | GTCCAGCGGTGTGCACACCTTCCCAGCTGTC<br>CTGGAGTCTGACCTCTACACTCTGAGCAGCT<br>CAGTGACTGTCCCCTCCAGCCCTCGGCCCAG<br>CGAGACCGTCACCTGCAACGTTGCCCACCCG<br>GCCAGCAGCACCAAGGTGGACAAGAAAATT<br>GTGCCCAGGGATTGTGGTTGTAAGCCTTGCA<br>TATGTACAGTCCCAGAAGTATCATCTGTCTT<br>CATCTTCCCCCCAAAGCCCAAGGATGTGCTC<br>ACCATTACTCTGACTCCTAAGGTCACGTGTG<br>TTGTGGTAGACATCAGCAAGGATGATCCCG<br>AGGTCCAGTTCAGCTGGTTTGTAGATGATGT<br>GGAGGTGCACACAGCTCAGACGCAACCCCG<br>GGAGGAGCAGTTCAACAGCACTTTCCGCTCA<br>GTCAGTGAACTTCCCATCATGCACCAGGACT<br>GGCTCAATGGCAAGGAGTTCAAATGCAGGG<br>TCAACAGTGCAGCTTTCCTGCCCCCATCGA<br>GAAAACCATCTCCAAAACCAAAGGCAGACC<br>GAAGGCTCCACAGGTGTACACCATTCCACCT<br>CCCAAGGAGCAGATGGCCAAGGATAAAGTC<br>AGTCTGACCTGCATGATAACAGACTTCTTCC<br>CTGAAGACATTACTGTGGAGTGGCAGTGGA<br>ATGGGCAGCCAGCGGAGAACTACAAGAACA<br>CTCAGCCCATCATGAACACGAATGGCTCTTA<br>CTTCGTCTACAGCAAGCTCAATGTGCAGAAG<br>AGCAACTGGGAGGCAGGAAATACTTTCACC<br>TGCTCTGTGTTACATGAGGGCCTGCACAACC<br>ACCATACTGAGAAGAGCCTCTCCCACTCTCC<br>TGGTAAATGA | |
| SM1B510 | pDR000034827 | ATGGCTTGGGTGTGGACCTTGCTATTCCTGA<br>TGGCAGCTGCCCAAAGTATACAGGCCCAGG<br>TGCAGCTGAAGGAGTCAGGACCTGGCCTGG<br>TGGCGCCCTCACAGAGCCTGTCCATCACATG<br>CACCGTCTCAGGGTTCTCATTAACCGGCTAT<br>GGTGTAAACTGGGTTCGCCAGCCTCCAGGA<br>AAGGGTCTGGAGTGGCTGGGGTTGATGTGG<br>GGTGATGGAAGCACAGACTATAATTCAGCT<br>CTCAACTCCAGACTGCGCATCAACAAGGAC<br>AACTCCAAGAGTCAAGTTTTCTTAAAAATGA<br>GCAGTCTTCAAACTGATGACACAGCCATTTA<br>CTACTGTGTCAGAAAGGGCGGTAATAGCCC<br>CTATGCTATGGACTACTGGGGTCAAGGAACC<br>TCAGTCACCGTCTCCTCAGCCAAAACGACAC<br>CCCCATCTGTCTATCCACTGGCCCCTGGATC<br>TGCTGCCCAAACTAACTCCATGGTGACCCTG<br>GGATGCCTGGTCAAGGGCTATTTCCCTGAGC<br>CAGTGACAGTGACCTGGAACTCTGGATCCCT<br>GTCCAGCGGTGTGCACACCTTCCCAGCTGTC<br>CTGGAGTCTGACCTCTACACTCTGAGCAGCT<br>CAGTGACTGTCCCCTCCAGCCCTCGGCCCAG<br>CGAGACCGTCACCTGCAACGTTGCCCACCCG<br>GCCAGCAGCACCAAGGTGGACAAGAAAATT<br>GTGCCCAGGGATTGTGGTTGTAAGCCTTGCA<br>TATGTACAGTCCCAGAAGTATCATCTGTCTT<br>CATCTTCCCCCCAAAGCCCAAGGATGTGCTC<br>ACCATTACTCTGACTCCTAAGGTCACGTGTG<br>TTGTGGTAGACATCAGCAAGGATGATCCCG<br>AGGTCCAGTTCAGCTGGTTTGTAGATGATGT<br>GGAGGTGCACACAGCTCAGACGCAACCCCG<br>GGAGGAGCAGTTCAACAGCACTTTCCGCTCA<br>GTCAGTGAACTTCCCATCATGCACCAGGACT<br>GGCTCAATGGCAAGGAGTTCAAATGCAGGG<br>TCAACAGTGCAGCTTTCCTGCCCCCATCGA<br>GAAAACCATCTCCAAAACCAAAGGCAGACC<br>GAAGGCTCCACAGGTGTACACCATTCCACCT<br>CCCAAGGAGCAGATGGCCAAGGATAAAGTC<br>AGTCTGACCTGCATGATAACAGACTTCTTCC<br>CTGAAGACATTACTGTGGAGTGGCAGTGGA<br>ATGGGCAGCCAGCGGAGAACTACAAGAACA<br>CTCAGCCCATCATGAACACGAATGGCTCTTA<br>CTTCGTCTACAGCAAGCTCAATGTGCAGAAG<br>AGCAACTGGGAGGCAGGAAATACTTTCACC<br>TGCTCTGTGTTACATGAGGGCCTGCACAACC<br>ACCATACTGAGAAGAGCCTCTCCCACTCTCC<br>TGGTAAATGA | 1017 |

TABLE 31-continued

LukE Antibody Heavy Chain Primary Transcripts

| mAB/Fab name | Construct ID | Heavy Chain Primary Transcript | SEQ ID NO: |
|---|---|---|---|
| SM1B511 | pDR000034830 | ATGGCTTGGGTGTGGACCTTGCTATTCCTGA<br>TGGCAGCTGCCCAAAGTATACAGGCCGAAG<br>TGAAGCTGGTGGAGTCTGGGCCTGAGCTGGT<br>GAAGCCTGGGGCTTCAGTGAAGATATCCTGC<br>AAGACTTCTGGTTACTCATTTACTGGCTACT<br>TTATGAATTGGGTGATGCAGAGCCATGGAA<br>AGAGCCTTGAGTGGATTGGACGTATTAATCC<br>TTACAATGGTGATACTTTCTACAACCAGAAG<br>TTCAAGGGCAAGGCCACATTGACTGTAGAC<br>AAATCCTCTAGCACAGCCCACATGGAGCTCC<br>GGAGCCTGGCATCTGAGGACTCTGCAGTCTA<br>TTATTGTGCAAGAAGCTACGGCTATGCTATG<br>GACTACTGGGGTCAAGGAACCTCAGTCACC<br>GTCTCCTCAGCCAAAACGACACCCCCATCTG<br>TCTATCCACTGGCCCCTGGATCTGCTGCCCA<br>AACTAACTCCATGGTGACCCTGGGATGCCTG<br>GTCAAGGGCTATTTCCCTGAGCCAGTGACAG<br>TGACCTGGAACTCTGGATCCCTGTCCAGCGG<br>TGTGCACACCTTCCCAGCTGTCCTGGAGTCT<br>GACCTCTACACTCTGAGCAGCTCAGTGACTG<br>TCCCCTCCAGCCCTCGGCCCAGCGAGACCGT<br>CACCTGCAACGTTGCCCACCCGGCCAGCAGC<br>ACCAAGGTGGACAAGAAAATTGTGCCCAGG<br>GATTGTGGTTGTAAGCCTTGCATATGTACAG<br>TCCCAGAAGTATCATCTGTCTTCATCTTCCCC<br>CCAAAGCCCAAGGATGTGCTCACCATTACTC<br>TGACTCCTAAGGTCACGTGTGTTGTGGTAGA<br>CATCAGCAAGGATGATCCCGAGGTCCAGTTC<br>AGCTGGTTTGTAGATGATGTGGAGGTGCACA<br>CAGCTCAGACGCAACCCCGGGAGGAGCAGT<br>TCAACAGCACTTTCCGCTCAGTCAGTGAACT<br>TCCCATCATGCACCAGGACTGGCTCAATGGC<br>AAGGAGTTCAAATGCAGGGTCAACAGTGCA<br>GCTTTCCCTGCCCCCATCGAGAAAACCATCT<br>CCAAAACCAAAGGCAGACCGAAGGCTCCAC<br>AGGTGTACACCATTCCACCTCCCAAGGAGCA<br>GATGGCCAAGGATAAAGTCAGTCTGACCTG<br>CATGATAACAGACTTCTTCCCTGAAGACATT<br>ACTGTGGAGTGGCAGTGGAATGGGCAGCCA<br>GCGGAGAACTACAAGAACACTCAGCCCATC<br>ATGAACACGAATGGCTCTTACTTCGTCTACA<br>GCAAGCTCAATGTGCAGAAGAGCAACTGGG<br>AGGCAGGAAATACTTTCACCTGCTCTGTGTT<br>ACATGAGGGCCTGCACAACCACCATACTGA<br>GAAGAGCCTCTCCCACTCTCCTGGTAAATGA | 1018 |
| SM1B512 | pDR000034830 | ATGGCTTGGGTGTGGACCTTGCTATTCCTGA<br>TGGCAGCTGCCCAAAGTATACAGGCCGAAG<br>TGAAGCTGGTGGAGTCTGGGCCTGAGCTGGT<br>GAAGCCTGGGGCTTCAGTGAAGATATCCTGC<br>AAGACTTCTGGTTACTCATTTACTGGCTACT<br>TTATGAATTGGGTGATGCAGAGCCATGGAA<br>AGAGCCTTGAGTGGATTGGACGTATTAATCC<br>TTACAATGGTGATACTTTCTACAACCAGAAG<br>TTCAAGGGCAAGGCCACATTGACTGTAGAC<br>AAATCCTCTAGCACAGCCCACATGGAGCTCC<br>GGAGCCTGGCATCTGAGGACTCTGCAGTCTA<br>TTATTGTGCAAGAAGCTACGGCTATGCTATG<br>GACTACTGGGGTCAAGGAACCTCAGTCACC<br>GTCTCCTCAGCCAAAACGACACCCCCATCTG<br>TCTATCCACTGGCCCCTGGATCTGCTGCCCA<br>AACTAACTCCATGGTGACCCTGGGATGCCTG<br>GTCAAGGGCTATTTCCCTGAGCCAGTGACAG<br>TGACCTGGAACTCTGGATCCCTGTCCAGCGG<br>TGTGCACACCTTCCCAGCTGTCCTGGAGTCT<br>GACCTCTACACTCTGAGCAGCTCAGTGACTG<br>TCCCCTCCAGCCCTCGGCCCAGCGAGACCGT<br>CACCTGCAACGTTGCCCACCCGGCCAGCAGC<br>ACCAAGGTGGACAAGAAAATTGTGCCCAGG<br>GATTGTGGTTGTAAGCCTTGCATATGTACAG<br>TCCCAGAAGTATCATCTGTCTTCATCTTCCCC<br>CCAAAGCCCAAGGATGTGCTCACCATTACTC<br>TGACTCCTAAGGTCACGTGTGTTGTGGTAGA<br>CATCAGCAAGGATGATCCCGAGGTCCAGTTC | 1019 |

TABLE 31-continued

LukE Antibody Heavy Chain Primary Transcripts

| mAB/Fab name | Construct ID | Heavy Chain Primary Transcript | SEQ ID NO: |
|---|---|---|---|
| | | AGCTGGTTTGTAGATGATGTGGAGGTGCACA<br>CAGCTCAGACGCAACCCCGGGAGGAGCAGT<br>TCAACAGCACTTTCCGCTCAGTCAGTGAACT<br>TCCCATCATGCACCAGGACTGGCTCAATGGC<br>AAGGAGTTCAAATGCAGGGTCAACAGTGCA<br>GCTTTCCCTGCCCCCATCGAGAAAACCATCT<br>CCAAAACCAAAGGCAGACCGAAGGCTCCAC<br>AGGTGTACACCATTCCACCTCCCAAGGAGCA<br>GATGGCCAAGGATAAAGTCAGTCTGACCTG<br>CATGATAACAGACTTCTTCCCTGAAGACATT<br>ACTGTGGAGTGGCAGTGGAATGGGCAGCCA<br>GCGGAGAACTACAAGAACACTCAGCCCATC<br>ATGAACACGAATGGCTCTTACTTCGTCTACA<br>GCAAGCTCAATGTGCAGAAGAGCAACTGGG<br>AGGCAGGAAATACTTTCACCTGCTCTGTGTT<br>ACATGAGGGCCTGCACAACCACCATACTGA<br>GAAGAGCCTCTCCCACTCTCCTGGTAAATGA | |
| SM1B513 | pDR000034831 | ATGGCTTGGGTGTGGACCTTGCTATTCCTGA<br>TGGCAGCTGCCCAAAGTATACAGGCCGAGG<br>TTCAGCTGCAGCAGTCTGGACCTGAGCTGGT<br>GAAGCCTGGGGCTTCAGTGAAGATATCCTGC<br>AAGGCTTCTGGTTACTCATTTACTGGCTACT<br>TTATGAATTGGGTGATGCAGAGCCATGGAA<br>AGAGCCTTGAGTGGATTGGACGTATTAATCC<br>TTACAATGGTGATACTTTCTACAACCAGAAA<br>TTCAAGGCCAAGGCCACATTGACTGTAGAC<br>AAATCCTCTAACACAGCCCACATGGAGCTCC<br>GGAGCCTGGCATCTGAGGACTCTGCAGTCTA<br>TTTTTGTGCAAGAAGTTACGGCTATGCTATG<br>GACTACTGGGGTCTAGGAACCTCAGTCACCG<br>TCTCCTCAGCCAAAACGACACCCCCATCTGT<br>CTATCCACTGGCCCCTGGATCTGCTGCCCAA<br>ACTAACTCCATGGTGACCCTGGGATGCCTGG<br>TCAAGGGCTATTTCCCTGAGCCAGTGACAGT<br>GACCTGGAACTCTGGATCCCTGTCCAGCGGT<br>GTGCACACCTTCCCAGCTGTCCTGGAGTCTG<br>ACCTCTACACTCTGAGCAGCTCAGTGACTGT<br>CCCCTCCAGCCCTCGGCCCAGCGAGACCGTC<br>ACCTGCAACGTTGCCCACCCGGCCAGCAGC<br>ACCAAGGTGGACAAGAAAATTGTGCCCAGG<br>GATTGTGGTTGTAAGCCTTGCATATGTACAG<br>TCCCAGAAGTATCATCTGTCTTCATCTTCCCC<br>CCAAAGCCCAAGGATGTGCTCACCATTACTC<br>TGACTCCTAAGGTCACGTGTGTTGTGGTAGA<br>CATCAGCAAGGATGATCCCGAGGTCCAGTTC<br>AGCTGGTTTGTAGATGATGTGGAGGTGCACA<br>CAGCTCAGACGCAACCCCGGGAGGAGCAGT<br>TCAACAGCACTTTCCGCTCAGTCAGTGAACT<br>TCCCATCATGCACCAGGACTGGCTCAATGGC<br>AAGGAGTTCAAATGCAGGGTCAACAGTGCA<br>GCTTTCCCTGCCCCCATCGAGAAAACCATCT<br>CCAAAACCAAAGGCAGACCGAAGGCTCCAC<br>AGGTGTACACCATTCCACCTCCCAAGGAGCA<br>GATGGCCAAGGATAAAGTCAGTCTGACCTG<br>CATGATAACAGACTTCTTCCCTGAAGACATT<br>ACTGTGGAGTGGCAGTGGAATGGGCAGCCA<br>GCGGAGAACTACAAGAACACTCAGCCCATC<br>ATGAACACGAATGGCTCTTACTTCGTCTACA<br>GCAAGCTCAATGTGCAGAAGAGCAACTGGG<br>AGGCAGGAAATACTTTCACCTGCTCTGTGTT<br>ACATGAGGGCCTGCACAACCACCATACTGA<br>GAAGAGCCTCTCCCACTCTCCTGGTAAATGA | 1020 |
| SM1B514 | pDR000034833 | ATGGCTTGGGTGTGGACCTTGCTATTCCTGA<br>TGGCAGCTGCCCAAAGTATACAGGCCGAGG<br>TTCAGCTGCAGCAGTCTGGGCCTGAACTAGT<br>GAAGACTGGGGCTTCAGTGAAGATATCCTG<br>CAAGGCTTCTGGTTACTCTTTCACTGGTTACT<br>ACATGCACTGGGTCAAGCAGAGCCATGGAA<br>AGAGCCTTGAGTGGATTGGATATCTTAGTTG<br>TTACAGTGGTGCTACTAGCTACAACCAGAAG<br>TTCAAGGGCAAGGCCACATTTACTGTAGACA<br>CATCCTCCACCACAGCCTACATGCAGTTCAA<br>CAGCCTGACATCTGAAGACTCTGCGGTCTAT | 1021 |

TABLE 31-continued

LukE Antibody Heavy Chain Primary Transcripts

| mAB/Fab name | Construct ID | Heavy Chain Primary Transcript | SEQ ID NO: |
|---|---|---|---|
| | | TACTGTGCACGAGGGGAGAGCTACTATGTTA TGGACTATTGGGGTCAAGGAACCTCAGTCAC CGTCTCCTCAGCCAAAACGACACCCCCATCT GTCTATCCACTGGCCCCTGGATCTGCTGCCC AAACTAACTCCATGGTGACCCTGGGATGCCT GGTCAAGGGCTATTTCCCTGAGCCAGTGACA GTGACCTGGAACTCTGGATCCCTGTCCAGCG GTGTGCACACCTTCCCAGCTGTCCTGGAGTC TGACCTCTACACTCTGAGCAGCTCAGTGACT GTCCCCTCCAGCCCTCGGCCCAGCGAGACCG TCACCTGCAACGTTGCCCACCCGGCCAGCAG CACCAAGGTGGACAAGAAAATTGTGCCCAG GGATTGTGGTTGTAAGCCTTGCATATGTACA GTCCCAGAAGTATCATCTGTCTTCATCTTCC CCCCAAAGCCCAAGGATGTGCTCACCATTAC TCTGACTCCTAAGGTCACGTGTGTTGTGGTA GACATCAGCAAGGATGATCCCGAGGTCCAG TTCAGCTGGTTTGTAGATGATGTGGAGGTGC ACACAGCTCAGACGCAACCCCGGGAGGAGC AGTTCAACAGCACTTTCCGCTCAGTCAGTGA ACTTCCCATCATGCACCAGGACTGGCTCAAT GGCAAGGAGTTCAAATGCAGGGTCAACAGT GCAGCTTTCCCTGCCCCCATCGAGAAAACCA TCTCCAAAACCAAAGGCAGACCGAAGGCTC CACAGGTGTACACCATTCCACCTCCCAAGGA GCAGATGGCCAAGGATAAAGTCAGTCTGAC CTGCATGATAACAGACTTCTTCCCTGAAGAC ATTACTGTGGAGTGGCAGTGGAATGGGCAG CCAGCGGAGAACTACAAGAACACTCAGCCC ATCATGAACACGAATGGCTCTTACTTCGTCT ACAGCAAGCTCAATGTGCAGAAGAGCAACT GGGAGGCAGGAAATACTTTCACCTGCTCTGT GTTACATGAGGGCCTGCACAACCACCATACT GAGAAGAGCCTCTCCCACTCTCCTGGTAAAT GA | |

TABLE 32

LukE Antibody Light Chain CDSs

| mAB/Fab name | Construct ID | Light Chain CDS | SEQ ID NO: |
|---|---|---|---|
| SM1B208 | pDR000027284 | GACATTGTGATGACCCAGTCTCCGCTCTCCCT GCCTGTCAGTCTTGGAGATCAAGCCTCCATCT CTTGCAGATCTAGTCAGGACATTGTACATAG TAATGGAAACACCTATTTAGGGTGGTACCTG CAGAAACCAGGCCGGTCTCCGAAGCTCCTGA TCTACAAAGTTTCCAACCGATTTTCTGGGGTC CCAGACAGGTTCAGTGGCAGTGGATCAGGGA CAGATTTCACACTCAAGATCAGCAGAGTGGA GGCTGAGGATCTGGGAGTTTATTACTGCTTTC AAAGCTCACATTTTCCGTGGACGTTCGGTGG AGGCACCAGGCTGGAAATCAAACGGGCTGAT GCTGCACCAACTGTATCCATCTTCCCACCATC CAGTGAGCAGTTAACATCTGGAGGTGCCTCA GTCGTGTGCTTCTTGAACAACTTCTACCCCAA AGACATCAATGTCAAGTGGAAGATTGATGGC AGTGAACGACAAAATGGCGTCCTGAACAGTT GGACTGATCAGGACAGCAAAGACAGCACCT ACAGCATGAGCAGCACCCTCACGTTGACCAA GGACGAGTATGAACGACATAACAGCTATACC TGTGAGGCCACTCACAAGACATCAACTTCAC CCATTGTCAAGAGCTTCAACAGGAATGAGTGT | 1022 |
| SM1B209 | pDR000027285 | GATGTTGTGATGACCCAAACTCCACTCTCCCT GCCTGTCAGTCTTGGAGATCAAGCCTCCATCT CTTGCAGATCTAGTCAGGACATTGTACATAG TAATGGAAACACCTATTTAGGGTGGTACCTG CAGAAACCAGGCCGGTCTCCGAAGCTCCTGA TCTACAAAGTTTCCAACCGATTTTCTGGGGTC CCAGACAGGTTCAGTGGCAGTGGATCAGGGA | 1023 |

TABLE 32-continued

LukE Antibody Light Chain CDSs

| mAB/Fab name | Construct ID | Light Chain CDS | SEQ ID NO: |
|---|---|---|---|
| | | CAGATTTCACACTCAAGATCAGCAGAGTGGA<br>GGCTGAGGATCTGGGAGTTTATTACTGCTTTC<br>AAAGCTCACATTTTCCGTGGACGTTCGGTGG<br>AGGCACCAGGCTGGAAATCAAACGGGCTGAT<br>GCTGCACCAACTGTATCCATCTTCCCACCATC<br>CAGTGAGCAGTTAACATCTGGAGGTGCCTCA<br>GTCGTGTGCTTCTTGAACAACTTCTACCCCAA<br>AGACATCAATGTCAAGTGGAAGATTGATGGC<br>AGTGAACGACAAAATGGCGTCCTGAACAGTT<br>GGACTGATCAGGACAGCAAAGACAGCACCT<br>ACAGCATGAGCAGCACCCTCACGTTGACCAA<br>GGACGAGTATGAACGACATAACAGCTATACC<br>TGTGAGGCCACTCACAAGACATCAACTTCAC<br>CCATTGTCAAGAGCTTCAACAGGAATGAGTGT | |
| SM1B210 | pDR000027283 | GATATTGTGCTAACTCAGTCTCCACTCTCCCT<br>GCCTGTCAGTCTTGGAGATCAAGCCTCCATCT<br>CTTGCAGATCTAGTCAGAGCCTTGTACACAG<br>TAATGGAAACACCTATTTACATTGGTACCTG<br>CAGAAGCCAGGCCAGTCTCCAAAGCTCCTGA<br>TCTACAAAGTTTCCAACCGATTTTCTGGGGTC<br>CCAGACAGGTTCAGTGGCAGTGGATCAGGGA<br>CAGATTTCACACTCAAGATCAGCAGAGTGGA<br>GGCTGAGGATCTGGGAGTTTATTTCTGCTCTC<br>AAAGTACACATGTTCCATTCACGTTCGGCTC<br>GGGGACAAAGTTGGAAATAAAACGGGCTGA<br>TGCTGCACCAACTGTATCCATCTTCCCACCAT<br>CCAGTGAGCAGTTAACATCTGGAGGTGCCTC<br>AGTCGTGTGCTTCTTGAACAACTTCTACCCCA<br>AAGACATCAATGTCAAGTGGAAGATTGATGG<br>CAGTGAACGACAAAATGGCGTCCTGAACAGT<br>TGGACTGATCAGGACAGCAAAGACAGCACCT<br>ACAGCATGAGCAGCACCCTCACGTTGACCAA<br>GGACGAGTATGAACGACATAACAGCTATACC<br>TGTGAGGCCACTCACAAGACATCAACTTCAC<br>CCATTGTCAAGAGCTTCAACAGGAATGAGTGT | 1024 |
| SM1B211 | pDR000027286 | GATATTGTGCTAACTCAGTCTCCAGCTTCTTT<br>GGCTGTGTCTCTAGGGCAGAGGGCCACCATA<br>TCCTGCAGAGCCAGTGAAAGTGTTGATAGTT<br>ATGGCAATAGTTTTATGCACTGGTACCAGCA<br>GAAACCAGGACAGCCACCCAAACTCCTCATC<br>TATCGTGCATCCAACCTAGAATCTGGGATCC<br>CTGCCAGGTTCAGTGGCAGTGGGTCTAGGAC<br>AGACTTCACCCTCACCATTAATCCTGTGGAG<br>GCTGATGATGTTGCAACCTATTACTGTCAGC<br>AAAGTAATGAGGATCCGCTCACGTTCGGTGC<br>TGGGACCAAGCTGGAGCTGAAACGGGCTGAT<br>GCTGCACCAACTGTATCCATCTTCCCACCATC<br>CAGTGAGCAGTTAACATCTGGAGGTGCCTCA<br>GTCGTGTGCTTCTTGAACAACTTCTACCCCAA<br>AGACATCAATGTCAAGTGGAAGATTGATGGC<br>AGTGAACGACAAAATGGCGTCCTGAACAGTT<br>GGACTGATCAGGACAGCAAAGACAGCACCT<br>ACAGCATGAGCAGCACCCTCACGTTGACCAA<br>GGACGAGTATGAACGACATAACAGCTATACC<br>TGTGAGGCCACTCACAAGACATCAACTTCAC<br>CCATTGTCAAGAGCTTCAACAGGAATGAGTGT | 1025 |
| SM1B507 | pDR000034834 | GACATTGTGATGACCCAGTCTCCAGCAATCA<br>TGTCTGCATCTCCAGGGGAGAAGGTCACCAT<br>ACCCTGCAGTGCCAGTTCAAGTGTAAGTTAC<br>ATGCACTGGTTCCAGCAGAAGCCAGGCACTT<br>CCCCCAAACTCTGGATTTATAGCACATCCAA<br>CCTGGCTTCTGGAGTCCCTGGTCGCTTCAGTG<br>GCAGTGGATCTGGGACCTCTTACTCTCTCACA<br>ATCAGCCGAATGGAGGCTGAAGATGCTGCCA<br>CTTATTACTGCCAGCAAAGGAGTAATTACCC<br>GCTCACGTTCGGTGCTGGGACCAAGCTGGAG<br>CTGAAACGGGCTGATGCTGCACCAACTGTAT<br>CCATCTTCCCACCATCCAGTGAGCAGTTAAC<br>ATCTGGAGGTGCCTCAGTCGTGTGCTTCTTGA<br>ACAACTTCTACCCCAAAGACATCAATGTCAA<br>GTGGAAGATTGATGGCAGTGAACGACAAAAT<br>GGCGTCCTGAACAGTTGGACTGATCAGGACA | 1026 |

TABLE 32-continued

LukE Antibody Light Chain CDSs

| mAB/Fab name | Construct ID | Light Chain CDS | SEQ ID NO: |
|---|---|---|---|
| | | GCAAAGACAGCACCTACAGCATGAGCAGCA CCCTCACGTTGACCAAGGACGAGTATGAACG ACATAACAGCTATACCTGTGAGGCCACTCAC AAGACATCAACTTCACCCATTGTCAAGAGCT TCAACAGGAATGAGTGT | |
| SM1B508 | pDR000034835 | GATGTTGTGATGACCCAAACTCCACTCTCCCT GCCTGTCAGTCTTGGAGATCAAGCCTCCATCT CTTGCAGATCTAGTCAGACCATTGTACATAG TAATGGAAACACCTATTTAGAATGGTACCTG CAGAAACCAGGCCAGTCTCCAAAGCTCCTGA TCTACAAAGTTTCCAACCGATTTTCTGGGGTC CCAGACAGGTTCAGTGGCAGTGGATCAGGGA CAGATTTCACACTCAAGATCAGCCGAGTGGA GGCTGAGGATCTGGGAGTTTATTACTGCTTTC AAGGTTCACATGTTCCGTTCACGTTCGGAGG GGGGACCAAGCTGGAAATAAGACGGGCTGA TGCTGCACCAACTGTATCCATCTTCCCACCAT CCAGTGAGCAGTTAACATCTGGAGGTGCCTC AGTCGTGTGCTTCTTGAACAACTTCTACCCCA AAGACATCAATGTCAAGTGGAAGATTGATGG CAGTGAACGACAAAATGGCGTCCTGAACAGT TGGACTGATCAGGACAGCAAAGACAGCACCT ACAGCATGAGCAGCACCCTCACGTTGACCAA GGACGAGTATGAACGACATAACAGCTATACC TGTGAGGCCACTCACAAGACATCAACTTCAC CCATTGTCAAGAGCTTCAACAGGAATGAGTGT | 1027 |
| SM1B509 | pDR000034836 | GATATTGTGATGACTCAGGCTGCAGCAATCA TGTCTGCATCTCCTGGGGAGAAGGTCACCTT GACCTGCAGTGCCAGTTCAAGTGTAAGTTCC AGCTACTTGTACTGGTACCAGCAGAAGCCAG GATCCTCCCCAAACTCTGGATTTATAGCAC ATCCAACCTGGCTTCTGGAGTCCCTGCTCGCT TCAGTGGCAGTGGGTCTGGGACCTCTTACTCT CTCACAATCAGCAGCATGGAGGCTGAAGATG CTGCCTCTTATTTCTGCCATCAGTGGACTACT TTCCCACCCACGTTCGGAGGGGGGACCAAGC TGGAAATAAAACGGGCTGATGCTGCACCAAC TGTATCCATCTTCCCACCATCCAGTGAGCAGT TAACATCTGGAGGTGCCTCAGTCGTGTGCTTC TTGAACAACTTCTACCCCAAAGACATCAATG TCAAGTGGAAGATTGATGGCAGTGAACGACA AAATGGCGTCCTGAACAGTTGGACTGATCAG GACAGCAAAGACAGCACCTACAGCATGAGC AGCACCCTCACGTTGACCAAGGACGAGTATG AACGACATAACAGCTATACCTGTGAGGCCAC TCACAAGACATCAACTTCACCCATTGTCAAG AGCTTCAACAGGAATGAGTGT | 1028 |
| SM1B510 | pDR000034838 | GATGTTGTGATGACCCAAACTCCACTCTCCCT GCCTGTCAGTCTTGGAGATCAAGCCTCCATCT CTTGCAGATCTAGTCAGAGCCTTGTACACAG TAATGGAAACACCTATTTACATTGGTACCTG CAGAAGCCAGGCCAGTCTCCAAAGCTCCTGA TCTACAAAGTTTCCAACCGATTTTCTGGGGTC CCAGACAGGTTCAGTGGCAGTGGATCAGGGA CAGATTTCACACTCAAGATCAGCAGAGTGGA GGCTGAGGATCTGGGAGTTTATTTCTGCTCTC AAAGTACACATGTTCCTCCGACGTTCGGTGG AGGCACCAAGCTGGAAATCAAACGGGCTGAT GCTGCACCAACTGTATCCATCTTCCCACCATC CAGTGAGCAGTTAACATCTGGAGGTGCCTCA GTCGTGTGCTTCTTGAACAACTTCTACCCCAA AGACATCAATGTCAAGTGGAAGATTGATGGC AGTGAACGACAAAATGGCGTCCTGAACAGTT GGACTGATCAGGACAGCAAAGACAGCACCT ACAGCATGAGCAGCACCCTCACGTTGACCAA GGACGAGTATGAACGACATAACAGCTATACC TGTGAGGCCACTCACAAGACATCAACTTCAC CCATTGTCAAGAGCTTCAACAGGAATGAGTGT | 1029 |
| SM1B511 | pDR000034839 | GATGTTGTGATGACCCAAACTCCACTCTCCCT GCCTGTCAGTCTTGGAGATCAAGCCTCCATCT CTTGCAGATCTAGTCAGAGCCTTGTACACAG | 1030 |

TABLE 32-continued

LukE Antibody Light Chain CDSs

| mAB/Fab name | Construct ID | Light Chain CDS | SEQ ID NO: |
|---|---|---|---|
| | | TAATGGAAACACCTATTTACATTGGTACCTG CAGAAGCCAGGCCAGTCTCCAAAGCTCCTGA TCTACAAAGTTTCCAACCGATTTTCTGGGGTC CCAGACAGGTTCAGTGGCAGTGGATCAGGGA CAGATTTCACACTCAAGATCAGCAGAGTGGA GGCTGAGGATCTGGGAGTTTATTTCTGCTCTC AAAGTACACATGTTCCTCTCACGTTCGGTGCT GGGACCAAGCTGGAGCTGAAACGGGCTGAT GCTGCACCAACTGTATCCATCTTCCCACCATC CAGTGAGCAGTTAACATCTGGAGGTGCCTCA GTCGTGTGCTTCTTGAACAACTTCTACCCCAA AGACATCAATGTCAAGTGGAAGATTGATGGC AGTGAACGACAAAATGGCGTCCTGAACAGTT GGACTGATCAGGACAGCAAAGACAGCACCT ACAGCATGAGCAGCACCCTCACGTTGACCAA GGACGAGTATGAACGACATAACAGCTATACC TGTGAGGCCACTCACAAGACATCAACTTCAC CCATTGTCAAGAGCTTCAACAGGAATGAGTGT | |
| SM1B512 | pDR000034840 | GACATCAAGATGACCCAGTCTCCACTCTCCC TGCCTGTCAGTCTTGGAGATCAAGCCTCCATC TCTTGCAGATCTAGTCAGACCATTGTACATA GTAATGGAAACACCTATTTAGAATGGTACCT GCAGAAACCAGGCCAGTCTCCAAAGCTCCTG ATCTACAAAGTTTCCAACCGATTTTCTGGGGT CCCAGACAGGTTCAGTGGCAGTGGATCAGGG ACAGATTTCACACTCAAGATCAGCCGAGTGG AGGCTGAGGATCTGGGAGTTTATTACTGCTTT CAAGGTTCACATGTTCCGTTCACGTTCGGAG GGGGGACCAAGCTGGAAATAAGACGGGCTG ATGCTGCACCAACTGTATCCATCTTCCCACCA TCCAGTGAGCAGTTAACATCTGGAGGTGCCT CAGTCGTGTGCTTCTTGAACAACTTCTACCCC AAAGACATCAATGTCAAGTGGAAGATTGATG GCAGTGAACGACAAAATGGCGTCCTGAACAG TTGGACTGATCAGGACAGCAAAGACAGCACC TACAGCATGAGCAGCACCCTCACGTTGACCA AGGACGAGTATGAACGACATAACAGCTATAC CTGTGAGGCCACTCACAAGACATCAACTTCA CCCATTGTCAAGAGCTTCAACAGGAATGAGT GT | 1031 |
| SM1B513 | pDR000034841 | GATATTGTGCTAACTCAGTCTCCAGCAATCAT GTCTGCATCTCCAGGGGAGAAGGTCACCATA ACCTGCAGTGCCAGCTCAAGTGTAAGTTACA TGCACTGGTTCCAGCAGAAGCCAGGCACTTC TCCCAAACTCTGGATTTATAGCACATCCAAC CTGGCTTCTGGAGTCCCTGCTCGCTTCAGTGG CAGTGGATCTGGGACCTCTTACTCTCTCACAA TCAGCCGAATGGAGGCTGAAGATGCTGCCAC TTATTACTGCCAGCAAAGGAGTAGTTACCCG TGGACGTTCGGTGGAGGCACCAAGCTGGAAA TCAAACGGGCTGATGCTGCACCAACTGTATC CATCTTCCCACCATCCAGTGAGCAGTTAACA TCTGGAGGTGCCTCAGTCGTGTGCTTCTTGAA CAACTTCTACCCCAAAGACATCAATGTCAAG TGGAAGATTGATGGCAGTGAACGACAAAATG GCGTCCTGAACAGTTGGACTGATCAGGACAG CAAAGACAGCACCTACAGCATGAGCAGCACC CTCACGTTGACCAAGGACGAGTATGAACGAC ATAACAGCTATACCTGTGAGGCCACTCACAA GACATCAACTTCACCCATTGTCAAGAGCTTC AACAGGAATGAGTGT | 1032 |
| SM1B514 | pDR000034843 | GACATTGTGATGACCCAGTCTCCATCTTCCAT GTATGCATCTCTAGGAGAGAGAGTCACTATC ACTTGCAAGGCGAGTCAGGACATTAATAGCT ATTTAAGCTGGTTCCAGCAGAAACCAGGAAA ATCTCCTAAGACCCTGATCTATCGTGCAAAC AGATTGGTAGATGGGGTCCCATCAAGGTTCA GTGGCAGTGGATCTGGGCAAGATTATTCTCT CACCATCAGCAGCCTGGAGTATGAAGATATG GGAATTTATTATTGTCTACAGTATGATGAGTT TCCGTACACGTTCGGAGGGGGGACCAAGCTG GAAATAAAACGGGCTGATGCTGCACCAACTG | 1033 |

TABLE 32-continued

LukE Antibody Light Chain CDSs

| mAB/Fab name | Construct ID | Light Chain CDS | SEQ ID NO: |
|---|---|---|---|
| | | TATCCATCTTCCCACCATCCAGTGAGCAGTTA<br>ACATCTGGAGGTGCCTCAGTCGTGTGCTTCTT<br>GAACAACTTCTACCCCAAAGACATCAATGTC<br>AAGTGGAAGATTGATGGCAGTGAACGACAA<br>AATGGCGTCCTGAACAGTTGGACTGATCAGG<br>ACAGCAAAGACAGCACCTACAGCATGAGCA<br>GCACCCTCACGTTGACCAAGGACGAGTATGA<br>ACGACATAACAGCTATACCTGTGAGGCCACT<br>CACAAGACATCAACTTCACCCATTGTCAAGA<br>GCTTCAACAGGAATGAGTGT | |

TABLE 33

LukE Antibody Light Chain Primary Transcripts

| mAB/Fab name | Construct ID | Light Chain Primary Transcript | SEQ ID NO: |
|---|---|---|---|
| SM1B208 | pDR000027284 | ATGGAGACACATTCTCAGGTCTTTGTATACAT<br>GTTGCTGTGGTTGTCTGGTGTCGAGGGCGAC<br>ATTGTGATGACCCAGTCTCCGCTCTCCCTGCC<br>TGTCAGTCTTGGAGATCAAGCCTCCATCTCTT<br>GCAGATCTAGTCAGGACATTGTACATAGTAA<br>TGGAAACACCTATTTAGGGTGGTACCTGCAG<br>AAACCAGGCCGGTCTCCGAAGCTCCTGATCT<br>ACAAAGTTTCCAACCGATTTTCTGGGGTCCC<br>AGACAGGTTCAGTGGCAGTGGATCAGGGACA<br>GATTTCACACTCAAGATCAGCAGAGTGGAGG<br>CTGAGGATCTGGGAGTTTATTACTGCTTTCAA<br>AGCTCACATTTTCCGTGGACGTTCGGTGGAG<br>GCACCAGGCTGGAAATCAAACGGGCTGATGC<br>TGCACCAACTGTATCCATCTTCCCACCATCCA<br>GTGAGCAGTTAACATCTGGAGGTGCCTCAGT<br>CGTGTGCTTCTTGAACAACTTCTACCCCAAAG<br>ACATCAATGTCAAGTGGAAGATTGATGGCAG<br>TGAACGACAAAATGGCGTCCTGAACAGTTGG<br>ACTGATCAGGACAGCAAAGACAGCACCTACA<br>GCATGAGCAGCACCCTCACGTTGACCAAGGA<br>CGAGTATGAACGACATAACAGCTATACCTGT<br>GAGGCCACTCACAAGACATCAACTTCACCCA<br>TTGTCAAGAGCTTCAACAGGAATGAGTGTTAG | 1034 |
| SM1B209 | pDR000027285 | ATGGAGACACATTCTCAGGTCTTTGTATACAT<br>GTTGCTGTGGTTGTCTGGTGTCGAGGGCGAT<br>GTTGTGATGACCCAAACTCCACTCTCCCTGCC<br>TGTCAGTCTTGGAGATCAAGCCTCCATCTCTT<br>GCAGATCTAGTCAGGACATTGTACATAGTAA<br>TGGAAACACCTATTTAGGGTGGTACCTGCAG<br>AAACCAGGCCGGTCTCCGAAGCTCCTGATCT<br>ACAAAGTTTCCAACCGATTTTCTGGGGTCCC<br>AGACAGGTTCAGTGGCAGTGGATCAGGGACA<br>GATTTCACACTCAAGATCAGCAGAGTGGAGG<br>CTGAGGATCTGGGAGTTTATTACTGCTTTCAA<br>AGCTCACATTTTCCGTGGACGTTCGGTGGAG<br>GCACCAGGCTGGAAATCAAACGGGCTGATGC<br>TGCACCAACTGTATCCATCTTCCCACCATCCA<br>GTGAGCAGTTAACATCTGGAGGTGCCTCAGT<br>CGTGTGCTTCTTGAACAACTTCTACCCCAAAG<br>ACATCAATGTCAAGTGGAAGATTGATGGCAG<br>TGAACGACAAAATGGCGTCCTGAACAGTTGG<br>ACTGATCAGGACAGCAAAGACAGCACCTACA<br>GCATGAGCAGCACCCTCACGTTGACCAAGGA<br>CGAGTATGAACGACATAACAGCTATACCTGT<br>GAGGCCACTCACAAGACATCAACTTCACCCA<br>TTGTCAAGAGCTTCAACAGGAATGAGTGTTAG | 1035 |
| SM1B210 | pDR000027283 | ATGGAGACACATTCTCAGGTCTTTGTATACAT<br>GTTGCTGTGGTTGTCTGGTGTCGAGGGCGAT<br>ATTGTGCTAACTCAGTCTCCACTCTCCCTGCC<br>TGTCAGTCTTGGAGATCAAGCCTCCATCTCTT<br>GCAGATCTAGTCAGAGCCTTGTACACAGTAA<br>TGGAAACACCTATTTACATTGGTACCTGCAG | 1036 |

TABLE 33-continued

LukE Antibody Light Chain Primary Transcripts

| mAB/Fab name | Construct ID | Light Chain Primary Transcript | SEQ ID NO: |
|---|---|---|---|
| | | AAGCCAGGCCAGTCTCCAAAGCTCCTGATCT ACAAAGTTTCCAACCGATTTTCTGGGGTCCC AGACAGGTTCAGTGGCAGTGGATCAGGGACA GATTTCACACTCAAGATCAGCAGAGTGGAGG CTGAGGATCTGGGAGTTTATTTCTGCTCTCAA AGTACACATGTTCCATTCACGTTCGGCTCGG GGACAAAGTTGGAAATAAAACGGGCTGATG CTGCACCAACTGTATCCATCTTCCCACCATCC AGTGAGCAGTTAACATCTGGAGGTGCCTCAG TCGTGTGCTTCTTGAACAACTTCTACCCCAAA GACATCAATGTCAAGTGGAAGATTGATGGCA GTGAACGACAAAATGGCGTCCTGAACAGTTG GACTGATCAGGACAGCAAAGACAGCACCTAC AGCATGAGCAGCACCCTCACGTTGACCAAGG ACGAGTATGAACGACATAACAGCTATACCTG TGAGGCCACTCACAAGACATCAACTTCACCC ATTGTCAAGAGCTTCAACAGGAATGAGTGTT AG | |
| SM1B211 | pDR000027286 | ATGGAGACACATTCTCAGGTCTTTGTATACAT GTTGCTGTGGTTGTCTGGTGTCGAGGGCGAT ATTGTGCTAACTCAGTCTCCAGCTTCTTTGGC TGTGTCTCTAGGGCAGAGGGCCACCATATCC TGCAGAGCCAGTGAAAGTGTTGATAGTTATG GCAATAGTTTTATGCACTGGTACCAGCAGAA ACCAGGACAGCCACCCAAACTCCTCATCTAT CGTGCATCCAACCTAGAATCTGGGATCCCTG CCAGGTTCAGTGGCAGTGGGTCTAGGACAGA CTTCACCCTCACCATTAATCCTGTGGAGGCTG ATGATGTTGCAACCTATTACTGTCAGCAAAG TAATGAGGATCCGCTCACGTTCGGTGCTGGG ACCAAGCTGGAGCTGAAACGGGCTGATGCTG CACCAACTGTATCCATCTTCCCACCATCCAGT GAGCAGTTAACATCTGGAGGTGCCTCAGTCG TGTGCTTCTTGAACAACTTCTACCCCAAAGAC ATCAATGTCAAGTGGAAGATTGATGGCAGTG AACGACAAAATGGCGTCCTGAACAGTTGGAC TGATCAGGACAGCAAAGACAGCACCTACAGC ATGAGCAGCACCCTCACGTTGACCAAGGACG AGTATGAACGACATAACAGCTATACCTGTGA GGCCACTCACAAGACATCAACTTCACCCATT GTCAAGAGCTTCAACAGGAATGAGTGTTAG | 1037 |
| SM1B507 | pDR000034834 | ATGGAGACACATTCTCAGGTCTTTGTATACAT GTTGCTGTGGTTGTCTGGTGTCGAGGGCGAC ATTGTGATGACCCAGTCTCCAGCAATCATGT CTGCATCTCCAGGGGAGAAGGTCACCATACC CTGCAGTGCCAGTTCAAGTGTAAGTTACATG CACTGGTTCCAGCAGAAGCCAGGCACTTCCC CCAAACTCTGGATTTATAGCACATCCAACCT GGCTTCTGGAGTCCCTGGTCGCTTCAGTGGC AGTGGATCTGGGACCTCTTACTCTCTCACAAT CAGCCGAATGGAGGCTGAAGATGCTGCCACT TATTACTGCCAGCAAAGGAGTAATTACCCGC TCACGTTCGGTGCTGGGACCAAGCTGGAGCT GAAACGGGCTGATGCTGCACCAACTGTATCC ATCTTCCCACCATCCAGTGAGCAGTTAACAT CTGGAGGTGCCTCAGTCGTGTGCTTCTTGAAC AACTTCTACCCCAAAGACATCAATGTCAAGT GGAAGATTGATGGCAGTGAACGACAAAATG GCGTCCTGAACAGTTGGACTGATCAGGACAG CAAAGACAGCACCTACAGCATGAGCAGCACC CTCACGTTGACCAAGGACGAGTATGAACGAC ATAACAGCTATACCTGTGAGGCCACTCACAA GACATCAACTTCACCCATTGTCAAGAGCTTC AACAGGAATGAGTGTTAG | 1038 |
| SM1B508 | pDR000034835 | ATGGAGACACATTCTCAGGTCTTTGTATACAT GTTGCTGTGGTTGTCTGGTGTCGAGGGCGAT GTTGTGATGACCCAAACTCCACTCTCCCTGCC TGTCAGTCTTGGAGATCAAGCCTCCATCTCTT GCAGATCTAGTCAGACCATTGTACATAGTAA TGGAAACACCTATTTAGAATGGTACCTGCAG AAACCAGGCCAGTCTCCAAAGCTCCTGATCT ACAAAGTTTCCAACCGATTTTCTGGGGTCCC | 1039 |

TABLE 33-continued

LukE Antibody Light Chain Primary Transcripts

| mAB/Fab name | Construct ID | Light Chain Primary Transcript | SEQ ID NO: |
|---|---|---|---|
| | | AGACAGGTTCAGTGGCAGTGGATCAGGGACA<br>GATTTCACACTCAAGATCAGCCGAGTGGAGG<br>CTGAGGATCTGGGAGTTTATTACTGCTTTCAA<br>GGTTCACATGTTCCGTTCACGTTCGGAGGGG<br>GGACCAAGCTGGAAATAAGACGGGCTGATG<br>CTGCACCAACTGTATCCATCTTCCCACCATCC<br>AGTGAGCAGTTAACATCTGGAGGTGCCTCAG<br>TCGTGTGCTTCTTGAACAACTTCTACCCCAAA<br>GACATCAATGTCAAGTGGAAGATTGATGGCA<br>GTGAACGACAAAATGGCGTCCTGAACAGTTG<br>GACTGATCAGGACAGCAAAGACAGCACCTAC<br>AGCATGAGCAGCACCCTCACGTTGACCAAGG<br>ACGAGTATGAACGACATAACAGCTATACCTG<br>TGAGGCCACTCACAAGACATCAACTTCACCC<br>ATTGTCAAGAGCTTCAACAGGAATGAGTGTT<br>AG | |
| SM1B509 | pDR000034836 | ATGGAGACACATTCTCAGGTCTTTGTATACAT<br>GTTGCTGTGGTTGTCTGGTGTCGAGGGCGAT<br>ATTGTGATGACTCAGGCTGCAGCAATCATGT<br>CTGCATCTCCTGGGGAGAAGGTCACCTTGAC<br>CTGCAGTGCCAGTTCAAGTGTAAGTTCCAGC<br>TACTTGTACTGGTACCAGCAGAAGCCAGGAT<br>CCTCCCCCAAACTCTGGATTTATAGCACATCC<br>AACCTGGCTTCTGGAGTCCCTGCTCGCTTCAG<br>TGGCAGTGGGTCTGGGACCTCTTACTCTCTCA<br>CAATCAGCAGCATGGAGGCTGAAGATGCTGC<br>CTCTTATTTCTGCCATCAGTGGACTACTTTCC<br>CACCCACGTTCGGAGGGGGGACCAAGCTGGA<br>AATAAAACGGGCTGATGCTGCACCAACTGTA<br>TCCATCTTCCCACCATCCAGTGAGCAGTTAAC<br>ATCTGGAGGTGCCTCAGTCGTGTGCTTCTTGA<br>ACAACTTCTACCCCAAAGACATCAATGTCAA<br>GTGGAAGATTGATGGCAGTGAACGACAAAAT<br>GGCGTCCTGAACAGTTGGACTGATCAGGACA<br>GCAAAGACAGCACCTACAGCATGAGCAGCA<br>CCCTCACGTTGACCAAGGACGAGTATGAACG<br>ACATAACAGCTATACCTGTGAGGCCACTCAC<br>AAGACATCAACTTCACCCATTGTCAAGAGCT<br>TCAACAGGAATGAGTGTTAG | 1040 |
| SM1B510 | pDR000034838 | ATGGAGACACATTCTCAGGTCTTTGTATACAT<br>GTTGCTGTGGTTGTCTGGTGTCGAGGGCGAT<br>GTTGTGATGACCCAAACTCCACTCTCCCTGCC<br>TGTCAGTCTTGGAGATCAAGCCTCCATCTCTT<br>GCAGATCTAGTCAGAGCCTTGTACACAGTAA<br>TGGAAACACCTATTTACATTGGTACCTGCAG<br>AAGCCAGGCCAGTCTCCAAAGCTCCTGATCT<br>ACAAAGTTTCCAACCGATTTTCTGGGGTCCC<br>AGACAGGTTCAGTGGCAGTGGATCAGGGACA<br>GATTTCACACTCAAGATCAGCAGAGTGGAGG<br>CTGAGGATCTGGGAGTTTATTTCTGCTCTCAA<br>AGTACACATGTTCCTCCGACGTTCGGTGGAG<br>GCACCAAGCTGGAAATCAAACGGGCTGATGC<br>TGCACCAACTGTATCCATCTTCCCACCATCCA<br>GTGAGCAGTTAACATCTGGAGGTGCCTCAGT<br>CGTGTGCTTCTTGAACAACTTCTACCCCAAAG<br>ACATCAATGTCAAGTGGAAGATTGATGGCAG<br>TGAACGACAAAATGGCGTCCTGAACAGTTGG<br>ACTGATCAGGACAGCAAAGACAGCACCTACA<br>GCATGAGCAGCACCCTCACGTTGACCAAGGA<br>CGAGTATGAACGACATAACAGCTATACCTGT<br>GAGGCCACTCACAAGACATCAACTTCACCCA<br>TTGTCAAGAGCTTCAACAGGAATGAGTGTTAG | 1041 |
| SM1B511 | pDR000034839 | ATGGAGACACATTCTCAGGTCTTTGTATACAT<br>GTTGCTGTGGTTGTCTGGTGTCGAGGGCGAT<br>GTTGTGATGACCCAAACTCCACTCTCCCTGCC<br>TGTCAGTCTTGGAGATCAAGCCTCCATCTCTT<br>GCAGATCTAGTCAGAGCCTTGTACACAGTAA<br>TGGAAACACCTATTTACATTGGTACCTGCAG<br>AAGCCAGGCCAGTCTCCAAAGCTCCTGATCT<br>ACAAAGTTTCCAACCGATTTTCTGGGGTCCC<br>AGACAGGTTCAGTGGCAGTGGATCAGGGACA<br>GATTTCACACTCAAGATCAGCAGAGTGGAGG | 1042 |

TABLE 33-continued

LukE Antibody Light Chain Primary Transcripts

| mAB/Fab name | Construct ID | Light Chain Primary Transcript | SEQ ID NO: |
|---|---|---|---|
| | | CTGAGGATCTGGGAGTTTATTTCTGCTCTCAA AGTACACATGTTCCTCTCACGTTCGGTGCTGG GACCAAGCTGGAGCTGAAACGGGCTGATGCT GCACCAACTGTATCCATCTTCCCACCATCCAG TGAGCAGTTAACATCTGGAGGTGCCTCAGTC GTGTGCTTCTTGAACAACTTCTACCCCAAAG ACATCAATGTCAAGTGGAAGATTGATGGCAG TGAACGACAAAATGGCGTCCTGAACAGTTGG ACTGATCAGGACAGCAAAGACAGCACCTACA GCATGAGCAGCACCCTCACGTTGACCAAGGA CGAGTATGAACGACATAACAGCTATACCTGT GAGGCCACTCACAAGACATCAACTTCACCCA TTGTCAAGAGCTTCAACAGGAATGAGTGTTAG | |
| SM1B512 | pDR000034840 | ATGGAGACACATTCTCAGGTCTTTGTATACAT GTTGCTGTGGTTGTCTGGTGTCGAGGGCGAC ATCAAGATGACCCAGTCTCCACTCTCCCTGCC TGTCAGTCTTGGAGATCAAGCCTCCATCTCTT GCAGATCTAGTCAGACCATTGTACATAGTAA TGGAAACACCTATTTAGAATGGTACCTGCAG AAACCAGGCCAGTCTCCAAAGCTCCTGATCT ACAAAGTTTCCAACCGATTTTCTGGGGTCCC AGACAGGTTCAGTGGCAGTGGATCAGGGACA GATTTCACACTCAAGATCAGCCGAGTGGAGG CTGAGGATCTGGGAGTTTATTACTGCTTTCAA GGTTCACATGTTCCGTTCACGTTCGGAGGGG GGACCAAGCTGGAAATAAGACGGGCTGATG CTGCACCAACTGTATCCATCTTCCCACCATCC AGTGAGCAGTTAACATCTGGAGGTGCCTCAG TCGTGTGCTTCTTGAACAACTTCTACCCCAAA GACATCAATGTCAAGTGGAAGATTGATGGCA GTGAACGACAAAATGGCGTCCTGAACAGTTG GACTGATCAGGACAGCAAAGACAGCACCTAC AGCATGAGCAGCACCCTCACGTTGACCAAGG ACGAGTATGAACGACATAACAGCTATACCTG TGAGGCCACTCACAAGACATCAACTTCACCC ATTGTCAAGAGCTTCAACAGGAATGAGTGTT AG | 1043 |
| SM1B513 | pDR000034841 | ATGGAGACACATTCTCAGGTCTTTGTATACAT GTTGCTGTGGTTGTCTGGTGTCGAGGGCGAT ATTGTGCTAACTCAGTCTCCAGCAATCATGTC TGCATCTCCAGGGGAGAAGGTCACCATAACC TGCAGTGCCAGCTCAAGTGTAAGTTACATGC ACTGGTTCCAGCAGAAGCCAGGCACTTCTCC CAAACTCTGGATTTATAGCACATCCAACCTG GCTTCTGGAGTCCCTGCTCGCTTCAGTGGCAG TGGATCTGGGACCTCTTACTCTCTCACAATCA GCCGAATGGAGGCTGAAGATGCTGCCACTTA TTACTGCCAGCAAAGGAGTAGTTACCCGTGG ACGTTCGGTGGAGGCACCAAGCTGGAAATCA AACGGGCTGATGCTGCACCAACTGTATCCAT CTTCCCACCATCCAGTGAGCAGTTAACATCT GGAGGTGCCTCAGTCGTGTGCTTCTTGAACA ACTTCTACCCCAAAGACATCAATGTCAAGTG GAAGATTGATGGCAGTGAACGACAAAATGG CGTCCTGAACAGTTGGACTGATCAGGACAGC AAAGACAGCACCTACAGCATGAGCAGCACCC TCACGTTGACCAAGGACGAGTATGAACGACA TAACAGCTATACCTGTGAGGCCACTCACAAG ACATCAACTTCACCCATTGTCAAGAGCTTCA ACAGGAATGAGTGTTAG | 1044 |
| SM1B514 | pDR000034843 | ATGGAGACACATTCTCAGGTCTTTGTATACAT GTTGCTGTGGTTGTCTGGTGTCGAGGGCGAC ATTGTGATGACCCAGTCTCCATCTTCCATGTA TGCATCTCTAGGAGAGAGTCACTATCACT TGCAAGGCGAGTCAGGACATTAATAGCTATT TAAGCTGGTTCCAGCAGAAACCAGGAAAATC TCCTAAGACCCTGATCTATCGTGCAAACAGA TTGGTAGATGGGGTCCCATCAAGGTTCAGTG GCAGTGGATCTGGGCAAGATTATTCTCTCAC CATCAGCAGCCTGGAGTATGAAGATATGGGA ATTATTATTGTCTACAGTATGATGAGTTTCC GTACACGTTCGGAGGGGGGACCAAGCTGGA | 1045 |

TABLE 33-continued

LukE Antibody Light Chain Primary Transcripts

| mAB/Fab name | Construct ID | Light Chain Primary Transcript | SEQ ID NO: |
|---|---|---|---|
| | | AATAAAACGGGCTGATGCTGCACCAACTGTA TCCATCTTCCCACCATCCAGTGAGCAGTTAAC ATCTGGAGGTGCCTCAGTCGTGTGCTTCTTGA ACAACTTCTACCCCAAAGACATCAATGTCAA GTGGAAGATTGATGGCAGTGAACGACAAAAT GGCGTCCTGAACAGTTGGACTGATCAGGACA GCAAAGACAGCACCTACAGCATGAGCAGCA CCCTCACGTTGACCAAGGACGAGTATGAACG ACATAACAGCTATACCTGTGAGGCCACTCAC AAGACATCAACTTCACCCATTGTCAAGAGCT TCAACAGGAATGAGTGTTAG | |

TABLE 34

LukD Antibody Heavy Chain CDSs

| mAB/Fab name | Construct ID | Heavy Chain CDS | SEQ ID NO: |
|---|---|---|---|
| SM1B221 | pDR000028067 | CAGGTTCAGCTGCAGCAGTCTGGGGCTGAGC TTGTGATGCCTGGGGCTTCAGTGAAGATGTC CTGCAAGGCTTCTGGCTACACATTCACTGACT ACTGGATGCACTGGGTGAAGCAGAGGCCTGG ACAAGGCCTTGAGTGGATCGGAGCGATTGAT ACTTCTGATAGTTATACTAGCTACAATCAAA AGTTCAAGGGCAAGGCCACATTGACTGTAGA CGAATCCTCCAGCACAGCCTACATGCAGCTC AGCAGCCTGACATCTGAGGACTCTGCGGTCT ATTACTGTGCAAGGGACTACGGCTACGCTAT GGACTACTGGGGTCAAGGAACCTCAGTCACC GTCTCCTCAGCCAAAACGACACCCCCATCTG TCTATCCACTGGCCCCTGGATCTGCTGCCCAA ACTAACTCCATGGTGACCCTGGGATGCCTGG TCAAGGGCTATTTCCCTGAGCCAGTGACAGT GACCTGGAACTCTGGATCCCTGTCCAGCGGT GTGCACACCTTCCCAGCTGTCCTGGAGTCTG ACCTCTACACTCTGAGCAGCTCAGTGACTGT CCCCTCCAGCCCTCGGCCCAGCGAGACCGTC ACCTGCAACGTTGCCCACCCGGCCAGCAGCA CCAAGGTGGACAAGAAAATTGTGCCCAGGG ATTGTGGTTGTAAGCCTTGCATATGTACAGTC CCAGAAGTATCATCTGTCTTCATCTTCCCCCC AAAGCCCAAGGATGTGCTCACCATTACTCTG ACTCCTAAGGTCACGTGTGTTGTGGTAGACA TCAGCAAGGATGATCCCGAGGTCCAGTTCAG CTGGTTTGTAGATGATGTGGAGGTCACACA GCTCAGACGCAACCCCGGGAGGAGCAGTTCA ACAGCACTTTCCGCTCAGTCAGTGAACTTCCC ATCATGCACCAGGACTGGCTCAATGGCAAGG AGTTCAAATGCAGGGTCAACAGTGCAGCTTT CCCTGCCCCCATCGAGAAAACCATCTCCAAA ACCAAAGGCAGACCGAAGGCTCCACAGGTGT ACACCATTCCACCTCCCAAGGAGCAGATGGC CAAGGATAAAGTCAGTCTGACCTGCATGATA ACAGACTTCTTCCCTGAAGACATTACTGTGG AGTGGCAGTGGAATGGGCAGCCAGCGGAGA ACTACAAGAACACTCAGCCCATCATGAACAC GAATGGCTCTTACTTCGTCTACAGCAAGCTC AATGTGCAGAAGAGCAACTGGGAGGCAGGA AATACTTTCACCTGCTCTGTGTTACATGAGGG CCTGCACAACCACCATACTGAGAAGAGCCTC TCCCACTCTCCTGGTAAA | 1046 |
| SM1B222 | pDR000028068 | GAGGTTCAGCTGCAGCAGTCTGGGGCTATGC TGGCAAGGCCTGGGGCTTCAGTGACGATGTC CTGCAAGGCTTCTGGCTACACCTTTACCGATT ACTGGATGCACTGGGTAAGACAGGGGCCTGG ACAGGGTCTGGAATGGATTGGCGCTATTTTT CCTGGAAATAGTGATACTACCTACAATCAGA AATTCAGGGGCAAGGCCAAACTGACTGCAGT CACATCTGCCATCACTGCCTACATGGAGGTC AGCAGCCTGACAAATATTGACTCTGCGGTCT | 1047 |

TABLE 34-continued

LukD Antibody Heavy Chain CDSs

| mAB/Fab name | Construct ID | Heavy Chain CDS | SEQ ID NO: |
|---|---|---|---|
| | | ATTACTGTACGGTAACTGAACTTGACTACTG<br>GGGCCAAGGCACCACTCTCACAGTCTCCTCA<br>GCCAAAACGACACCCCCATCTGTCTATCCAC<br>TGGCCCCTGGATCTGCTGCCCAAACTAACTC<br>CATGGTGACCCTGGGATGCCTGGTCAAGGGC<br>TATTTCCCTGAGCCAGTGACAGTGACCTGGA<br>ACTCTGGATCCCTGTCCAGCGGTGTGCACAC<br>CTTCCCAGCTGTCCTGGAGTCTGACCTCTACA<br>CTCTGAGCAGCTCAGTGACTGTCCCCTCCAG<br>CCCTCGGCCCAGCGAGACCGTCACCTGCAAC<br>GTTGCCCACCCGGCCAGCAGCACCAAGGTGG<br>ACAAGAAAATTGTGCCCAGGGATTGTGGTTG<br>TAAGCCTTGCATATGTACAGTCCCAGAAGTA<br>TCATCTGTCTTCATCTTCCCCCCAAAGCCCAA<br>GGATGTGCTCACCATTACTCTGACTCCTAAG<br>GTCACGTGTGTTGTGGTAGACATCAGCAAGG<br>ATGATCCCGAGGTCCAGTTCAGCTGGTTTGT<br>AGATGATGTGGAGGTGCACACAGCTCAGACG<br>CAACCCCGGGAGGAGCAGTTCAACAGCACTT<br>TCCGCTCAGTCAGTGAACTTCCCATCATGCAC<br>CAGGACTGGCTCAATGGCAAGGAGTTCAAAT<br>GCAGGGTCAACAGTGCAGCTTTCCCTGCCCC<br>CATCGAGAAAACCATCTCCAAAACCAAAGGC<br>AGACCGAAGGCTCCACAGGTGTACACCATTC<br>CACCTCCCAAGGAGCAGATGGCCAAGGATAA<br>AGTCAGTCTGACCTGCATGATAACAGACTTC<br>TTCCCTGAAGACATTACTGTGGAGTGGCAGT<br>GGAATGGGCAGCCAGCGGAGAACTACAAGA<br>ACACTCAGCCCATCATGAACACGAATGGCTC<br>TTACTTCGTCTACAGCAAGCTCAATGTGCAG<br>AAGAGCAACTGGGAGGCAGGAAATACTTTCA<br>CCTGCTCTGTGTTACATGAGGGCCTGCACAA<br>CCACCATACTGAGAAGAGCCTCTCCCACTCT<br>CCTGGTAAA | |
| SM1B223 | pDR000028069 | GAGGTTCAGCTGCAGCAGTCTGGGGCTGACC<br>TTGTGATGCCTGGGACTTCAATGAAGCTGTC<br>CTGCAAGGCTTCTGGCTACACATTCACTGACT<br>ACTGGATTCACTGGGTGAAGCAGGGGCCTGG<br>ACAAGGCCTTGAGTGGATCGGAGCGATTGAT<br>ACTTCGGATAGTTATATTAATTACAATCAAA<br>AGTTCACGGACAAGGCCACATTGACCGTTGA<br>CGAATCCTCCAGCACAGCCTACATGCACCTC<br>AGCAGCCTGACATCTGAGGACTCTGCGGTCT<br>ATTATTGTGCAAGGGACTACGGCTACGCTAT<br>GGACTACTGGGGTCAAGGAACCTCAGTCACC<br>GTCTCCTCAGCCAAAACGACACCCCCATCTG<br>TCTATCCACTGGCCCCTGGATCTGCTGCCCAA<br>ACTAACTCCATGGTGACCCTGGGATGCCTGG<br>TCAAGGGCTATTTCCCTGAGCCAGTGACAGT<br>GACCTGGAACTCTGGATCCCTGTCCAGCGGT<br>GTGCACACCTTCCCAGCTGTCCTGGAGTCTG<br>ACCTCTACACTCTGAGCAGCTCAGTGACTGT<br>CCCCTCCAGCCCTCGGCCCAGCGAGACCGTC<br>ACCTGCAACGTTGCCCACCCGGCCAGCAGCA<br>CCAAGGTGGACAAGAAAATTGTGCCCAGGG<br>ATTGTGGTTGTAAGCCTTGCATATGTACAGTC<br>CCAGAAGTATCATCTGTCTTCATCTTCCCCCC<br>AAAGCCCAAGGATGTGCTCACCATTACTCTG<br>ACTCCTAAGGTCACGTGTGTTGTGGTAGACA<br>TCAGCAAGGATGATCCCGAGGTCCAGTTCAG<br>CTGGTTTGTAGATGATGTGGAGGTGCACACA<br>GCTCAGACGCAACCCCGGGAGGAGCAGTTCA<br>ACAGCACTTTCCGCTCAGTCAGTGAACTTCCC<br>ATCATGCACCAGGACTGGCTCAATGGCAAGG<br>AGTTCAAATGCAGGGTCAACAGTGCAGCTTT<br>CCCTGCCCCCATCGAGAAAACCATCTCCAAA<br>ACCAAAGGCAGACCGAAGGCTCCACAGGTGT<br>ACACCATTCCACCTCCCAAGGAGCAGATGGC<br>CAAGGATAAAGTCAGTCTGACCTGCATGATA<br>ACAGACTTCTTCCCTGAAGACATTACTGTGG<br>AGTGGCAGTGGAATGGGCAGCCAGCGGAGA<br>ACTACAAGAACACTCAGCCCATCATGAACAC<br>GAATGGCTCTTACTTCGTCTACAGCAAGCTC<br>AATGTGCAGAAGAGCAACTGGGAGGCAGGA | 1048 |

TABLE 34-continued

LukD Antibody Heavy Chain CDSs

| mAB/Fab name | Construct ID | Heavy Chain CDS | SEQ ID NO: |
|---|---|---|---|
| | | AATACTTTCACCTGCTCTGTGTTACATGAGGG<br>CCTGCACAACCACCATACTGAGAAGAGCCTC<br>TCCCACTCTCCTGGTAAA | |
| SM1B224 | pDR000028070 | CAGGTCCAACTGCAGCAGCCTGGGGCTGAGC<br>TTGTGATGCCTGGGTCTTCAGTGAAGATGTCC<br>TGCAAGGCTTCTGGCTACACATTCACTGATTA<br>CTGGATGCACTGGGTGAAGCAGAGGCCGGG<br>ACAAGGCCTTGAGTGGATCGGAGCGATTGAT<br>GCTTCTGATAGTTATACTAGCTACGATCAAA<br>AGTTCAAGGGCAAGGCCACATTGACTGTTGA<br>CGATTCCTCCAGCACAGCCTACATTCACCTCA<br>ACAGCCTGACATCTGAGGACTCTGCGGTCTA<br>TTACTGTGCAAGAGACTTCGGCTATGCTATG<br>GACTACTGGGGTCAAGGAACCTCAGTCACCG<br>TCTCCTCAGCCAAAACGACACCCCCATCTGT<br>CTATCCACTGGCCCCTGGATCTGCTGCCCAA<br>ACTAACTCCATGGTGACCCTGGGATGCCTGG<br>TCAAGGGCTATTTCCCTGAGCCAGTGACAGT<br>GACCTGGAACTCTGGATCCCTGTCCAGCGGT<br>GTGCACACCTTCCCAGCTGTCCTGGAGTCTG<br>ACCTCTACACTCTGAGCAGCTCAGTGACTGT<br>CCCCTCCAGCCCTCGGCCCAGCGAGACCGTC<br>ACCTGCAACGTTGCCCACCCGGCCAGCAGCA<br>CCAAGGTGGACAAGAAAATTGTGCCCAGGG<br>ATTGTGGTTGTAAGCCTTGCATATGTACAGTC<br>CCAGAAGTATCATCTGTCTTCATCTTCCCCCC<br>AAAGCCCAAGGATGTGCTCACCATTACTCTG<br>ACTCCTAAGGTCACGTGTGTTGTGGTAGACA<br>TCAGCAAGGATGATCCCGAGGTCCAGTTCAG<br>CTGGTTTGTAGATGATGTGGAGGTGCACACA<br>GCTCAGACGCAACCCCGGGAGGAGCAGTTCA<br>ACAGCACTTTCCGCTCAGTCAGTGAACTTCCC<br>ATCATGCACCAGGACTGGCTCAATGGCAAGG<br>AGTTCAAATGCAGGGTCAACAGTGCAGCTTT<br>CCCTGCCCCCATCGAGAAAACCATCTCCAAA<br>ACCAAAGGCAGACCGAAGGCTCCACAGGTGT<br>ACACCATTCCACCTCCCAAGGAGCAGATGGC<br>CAAGGATAAAGTCAGTCTGACCTGCATGATA<br>ACAGACTTCTTCCCTGAAGACATTACTGTGG<br>AGTGGCAGTGGAATGGGCAGCCAGCGGAGA<br>ACTACAAGAACACTCAGCCCATCATGAACAC<br>GAATGGCTCTTACTTCGTCTACAGCAAGCTC<br>AATGTGCAGAAGAGCAACTGGGAGGCAGGA<br>AATACTTTCACCTGCTCTGTGTTACATGAGGG<br>CCTGCACAACCACCATACTGAGAAGAGCCTC<br>TCCCACTCTCCTGGTAAA | 1049 |
| SM1B225 | pDR000028071 | GAGGTTCAGCTGCAGCAGTCTGGGGGAGGCT<br>TAGTGAAGCCTGGAGGGTCCCTGAAACTCTC<br>CTGTGCAGCCTCTGGATTCACTTTCAGTAGCT<br>ATGCCATGTCTTGGGTTCGCCAGACTCCGGA<br>GAAGAGGCTGGAGTGGGTCGCAACCATTACT<br>GGTGGTGGTACTTACACCTACTATCTAGACA<br>GTGTGAAGGGTCGATTCACCATCTCCAGAGA<br>CAATGCCAAGACCTCCCTGTACCTGCAAATG<br>AGCAGTCTGAGGTCGGAGGACACGGCCATGT<br>ATTACTGTGCAAGACATCGGGATGGTAACTA<br>CGGGTGCTTCGATGTCTGGGGCGCAGGGACC<br>ACGGTCACCGTCTCCTCAGCCAAAACGACAC<br>CCCCATCTGTCTATCCACTGGCCCCTGGATCT<br>GCTGCCCAAACTAACCCCATGGTGACCCTGG<br>GATGCCTGGTCAAGGGCTATTTCCCTGAGCC<br>AGTGACAGTGACCTGGAACTCTGGATCCCTG<br>TCCAGCGGTGTGCACACCTTCCCAGCTGTCCT<br>GGAGTCTGACCTCTACACTCTGAGCAGCTCA<br>GTGACTGTCCCCTCCAGCCCTCGGCCCAGCG<br>AGACCGTCACCTGCAACGTTGCCCACCCGGC<br>CAGCAGCACCAAGGTGGACAAGAAAATTGT<br>GCCCAGGGATTGTGGTTGTAAGCCTTGCATA<br>TGTACAGTCCCAGAAGTATCATCTGTCTTCAT<br>CTTCCCCCCAAAGCCCAAGGATGTGCTCACC<br>ATTACTCTGACTCCTAAGGTCACGTGTGTTGT<br>GGTAGACATCAGCAAGGATGATCCCGAGGTC<br>CAGTTCAGCTGGTTTGTAGATGATGTGGAGG | 1050 |

TABLE 34-continued

LukD Antibody Heavy Chain CDSs

| mAB/Fab name | Construct ID | Heavy Chain CDS | SEQ ID NO: |
|---|---|---|---|
| | | TGCACACAGCTCAGACGCAACCCCGGGAGGA<br>GCAGTTCAACAGCACTTTCCGCTCAGTCAGT<br>GAACTTCCCATCATGCACCAGGACTGGCTCA<br>ATGGCAAGGAGTTCAAATGCAGGGTCAACAG<br>TGCAGCTTTCCCTGCCCCCATCGAGAAAACC<br>ATCTCCAAAACCAAAGGCAGACCGAAGGCTC<br>CACAGGTGTACACCATTCCACCTCCCAAGGA<br>GCAGATGGCCAAGGATAAAGTCAGTCTGACC<br>TGCATGATAACAGACTTCTTCCCTGAAGACA<br>TTACTGTGGAGTGGCAGTGGAATGGGCAGCC<br>AGCGGAGAACTACAAGAACACTCAGCCCATC<br>ATGAACACGAATGGCTCTTACTTCGTCTACA<br>GCAAGCTCAATGTGCAGAAGAGCAACTGGG<br>AGGCAGGAAATACTTTCACCTGCTCTGTGTT<br>ACATGAGGGCCTGCACAACCACCATACTGAG<br>AAGAGCCTCTCCCACTCTCCTGGTAAA | |
| SM1B226 | pDR000028072 | GAGGTTCAGCTGCAGCAGTCTGGGGCTGAGC<br>TTGTGATGCCTGGGGCTTCAGTGAAGATGTC<br>CTGCAAGGCTTCTGGTTACACATTCACTGACT<br>ACTGGATGCACTGGGTGCTGCAGAGGCCTGG<br>ACAAGGCCTTGAGTGGATCGGAGCGATTGAT<br>ACTTCTGATAGTTATACTACCTACAATCAAA<br>AATTCAAGGGCAAGGCCACATTGACTGTAGA<br>CGAATCCTCCAGCACGGCCTACATGCTGCTC<br>AGCAGCCTGACATCTGAGGACTCTGCGGTCT<br>ATTACTGTGCAAGAGACTACGGCTATGCTAT<br>GGACTACTGGGGTCAAGGATCCTCAGTCACC<br>GTCTCCTCAGCCAAAACGACACCCCCATCTG<br>TCTATCCACTGGCCCCTGGATCTGCTGCCCAA<br>ACTAACTCCATGGTGACCCTGGGATGCCTGG<br>TCAAGGGCTATTTCCCTGAGCCAGTGACAGT<br>GACCTGGAACTCTGGATCCCTGTCCAGCGGT<br>GTGCACACCTTCCCAGCTGTCCTGGAGTCTG<br>ACCTCTACACTCTGAGCAGCTCAGTGACTGT<br>CCCCTCCAGCCCTCGGCCCAGCGAGACCGTC<br>ACCTGCAACGTTGCCCACCCGGCCAGCAGCA<br>CCAAGGTGGACAAGAAAATTGTGCCCAGGG<br>ATTGTGGTTGTAAGCCTTGCATATGTACAGTC<br>CCAGAAGTATCATCTGTCTTCATCTTCCCCCC<br>AAAGCCCAAGGATGTGCTCACCATTACTCTG<br>ACTCCTAAGGTCACGTGTGTTGTGGTAGACA<br>TCAGCAAGGATGATCCCGAGGTCCAGTTCAG<br>CTGGTTTGTAGATGATGTGGAGGTGCACACA<br>GCTCAGACGCAACCCCGGGAGGAGCAGTTCA<br>ACAGCACTTTCCGCTCAGTCAGTGAACTTCCC<br>ATCATGCACCAGGACTGGCTCAATGGCAAGG<br>AGTTCAAATGCAGGGTCAACAGTGCAGCTTT<br>CCCTGCCCCCATCGAGAAAACCATCTCCAAA<br>ACCAAAGGCAGACCGAAGGCTCCACAGGTGT<br>ACACCATTCCACCTCCCAAGGAGCAGATGGC<br>CAAGGATAAAGTCAGTCTGACCTGCATGATA<br>ACAGACTTCTTCCCTGAAGACATTACTGTGG<br>AGTGGCAGTGGAATGGGCAGCCAGCGGAGA<br>ACTACAAGAACACTCAGCCCATCATGAACAC<br>GAATGGCTCTTACTTCGTCTACAGCAAGCTC<br>AATGTGCAGAAGAGCAACTGGGAGGCAGGA<br>AATACTTTCACCTGCTCTGTGTTACATGAGGG<br>CCTGCACAACCACCATACTGAGAAGAGCCTC<br>TCCCACTCTCCTGGTAAA | 1051 |
| SM1B227 | pDR000028073 | GAGTTCCAGCTGCAGCAGTCTGGACCTGAGC<br>TGGTAAAGCCTGGGGCTTCAGTGAAGATGTC<br>CTGCAAGGCTTCTGGATACACATTCACTAGC<br>TATTTTATACACTGGGTGAAGCAGAAGCCTG<br>GACAGGGCCTTGAGTGGATTGGATTTATTAA<br>TCCTTACAATGCTGATACTAACTACAATGAG<br>AAATTCAAAGGCAAGGCCACACTGACTTCAG<br>ACAAATCCTCCAGCACAGCCTACATGGAGCT<br>CAGCAGCCTGACCTCTGAGGACTCTGCGGTC<br>TATTACTGTACTCCGAGTGCTATGGACTACTG<br>GGGTCAAGGAACCTCAGTCACCGTCTCCTCA<br>GCCAAAACGACACCCCCATCTGTCTATCCAC<br>TGGCCCCTGGATCTGCTGCCCAAACTAACTC<br>CATGGTGACCCTGGGATGCCTGGTCAAGGGC | 1052 |

TABLE 34-continued

LukD Antibody Heavy Chain CDSs

| mAB/Fab name | Construct ID | Heavy Chain CDS | SEQ ID NO: |
|---|---|---|---|
| | | TATTTCCCTGAGCCAGTGACAGTGACCTGGA ACTCTGGATCCCTGTCCAGCGGTGTGCACAC CTTCCCAGCTGTCCTGGAGTCTGACCTCTACA CTCTGAGCAGCTCAGTGACTGTCCCCTCCAG CCCTCGGCCCAGCGAGACCGTCACCTGCAAC GTTGCCCACCCGGCCAGCAGCACCAAGGTGG ACAAGAAAATTGTGCCCAGGGATTGTGGTTG TAAGCCTTGCATATGTACAGTCCCAGAAGTA TCATCTGTCTTCATCTTCCCCCCAAAGCCCAA GGATGTGCTCACCATTACTCTGACTCCTAAG GTCACGTGTGTTGTGGTAGACATCAGCAAGG ATGATCCCGAGGTCCAGTTCAGCTGGTTTGT AGATGATGTGGAGGTGCACACAGCTCAGACG CAACCCCGGGAGGAGCAGTTCAACAGCACTT TCCGCTCAGTCAGTGAACTTCCCATCATGCAC CAGGACTGGCTCAATGGCAAGGAGTTCAAAT GCAGGGTCAACAGTGCAGCTTTCCCTGCCCC CATCGAGAAAACCATCTCCAAAACCAAAGGC AGACCGAAGGCTCCACAGGTGTACACCATTC CACCTCCCAAGGAGCAGATGGCCAAGGATAA AGTCAGTCTGACCTGCATGATAACAGACTTC TTCCCTGAAGACATTACTGTGGAGTGGCAGT GGAATGGGCAGCCAGCGGAGAACTACAAGA ACACTCAGCCCATCATGAACACGAATGGCTC TTACTTCGTCTACAGCAAGCTCAATGTGCAG AAGAGCAACTGGGAGGCAGGAAATACTTTCA CCTGCTCTGTGTTACATGAGGGCCTGCACAA CCACCATACTGAGAAGAGCCTCTCCCACTCT CCTGGTAAA | |
| SM1B228 | pDR000028074 | CAGGTTCAGCTGCAGCAGTCTGGGGCTGAGC TTGTGATGCCTGGGGCTTCAGTGAAGATGTC CTGCAAGGCTTCTGGCTACACATTCACTGACT ACTGGATGCACTGGGTGAAGCAGAGGCCTGG ACAAGGCCTTGAGTGGATCGGAGCGATTGAT ACTTCTGATAGTTATACTACCTACAATCAAA AGTTCAAGGGCAAGGCCACATTGACTGTAGA CGAATCCTCCAGCACAGCCTACATGCAGCTC AGCAGCCTGACATCTGAGGACTCTGCGGTCT ATTACTGTGCAAGGGACTACGGCTACGCTAT GGACTACTGGGGTCAAGGAACCTCAGTCACC GTCTCCTCAGCCAAAACGACACCCCCATCTG TCTATCCACTGGCCCCTGGATCTGCTGCCCAA ACTAACTCCATGGTGACCCTGGGATGCCTGG TCAAGGGCTATTTCCCTGAGCCAGTGACAGT GACCTGGAACTCTGGATCCCTGTCCAGCGGT GTGCACACCTTCCCAGCTGTCCTGGAGTCTG ACCTCTACACTCTGAGCAGCTCAGTGACTGT CCCCTCCAGCCCTCGGCCCAGCGAGACCGTC ACCTGCAACGTTGCCCACCCGGCCAGCAGCA CCAAGGTGGACAAGAAAATTGTGCCCAGGG ATTGTGGTTGTAAGCCTTGCATATGTACAGTC CCAGAAGTATCATCTGTCTTCATCTTCCCCCC AAAGCCCAAGGATGTGCTCACCATTACTCTG ACTCCTAAGGTCACGTGTGTTGTGGTAGACA TCAGCAAGGATGATCCCGAGGTCCAGTTCAG CTGGTTTGTAGATGATGTGGAGGTGCACACA GCTCAGACGCAACCCCGGGAGGAGCAGTTCA ACAGCACTTTCCGCTCAGTCAGTGAACTTCCC ATCATGCACCAGGACTGGCTCAATGGCAAGG AGTTCAAATGCAGGGTCAACAGTGCAGCTTT CCCTGCCCCCATCGAGAAAACCATCTCCAAA ACCAAAGGCAGACCGAAGGCTCCACAGGTGT ACACCATTCCACCTCCCAAGGAGCAGATGGC CAAGGATAAAGTCAGTCTGACCTGCATGATA ACAGACTTCTTCCCTGAAGACATTACTGTGG AGTGGCAGTGGAATGGGCAGCCAGCGGAGA ACTACAAGAACACTCAGCCCATCATGAACAC GAATGGCTCTTACTTCGTCTACAGCAAGCTC AATGTGCAGAAGAGCAACTGGGAGGCAGGA AATACTTTCACCTGCTCTGTGTTACATGAGGG CCTGCACAACCACCATACTGAGAAGAGCCTC TCCCACTCTCCTGGTAAA | 1053 |

TABLE 35

LukD Antibody Heavy Chain Primary Transcripts

| mAB/Fab name | Construct ID | Heavy Chain Primary Transcript | SEQ ID NO: |
|---|---|---|---|
| SM1B221 | pDR000028067 | ATGGCTTGGGTGTGGACCTTGCTATTCCTGATG GCAGCTGCCCAAAGTATACAGGCCCAGGTTCA GCTGCAGCAGTCTGGGGCTGAGCTTGTGATGC CTGGGGCTTCAGTGAAGATGTCCTGCAAGGCT TCTGGCTACACATTCACTGACTACTGGATGCAC TGGGTGAAGCAGAGGCCTGGACAAGGCCTTGA GTGGATCGGAGCGATTGATACTTCTGATAGTT ATACTAGCTACAATCAAAAGTTCAAGGGCAAG GCCACATTGACTGTAGACGAATCCTCCAGCAC AGCCTACATGCAGCTCAGCAGCCTGACATCTG AGGACTCTGCGGTCTATTACTGTGCAAGGGAC TACGGCTACGCTATGGACTACTGGGGTCAAGG AACCTCAGTCACCGTCTCCTCAGCCAAAACGA CACCCCCATCTGTCTATCCACTGGCCCCTGGAT CTGCTGCCCAAACTAACTCCATGGTGACCCTG GGATGCCTGGTCAAGGGCTATTTCCCTGAGCC AGTGACAGTGACCTGGAACTCTGGATCCCTGT CCAGCGGTGTGCACACCTTCCCAGCTGTCCTGG AGTCTGACCTCTACACTCTGAGCAGCTCAGTG ACTGTCCCCTCCAGCCCTCGGCCCAGCGAGAC CGTCACCTGCAACGTTGCCCACCCGGCCAGCA GCACCAAGGTGGACAAGAAAATTGTGCCCAGG GATTGTGGTTGTAAGCCTTGCATATGTACAGTC CCAGAAGTATCATCTGTCTTCATCTTCCCCCCA AAGCCCAAGGATGTGCTCACCATTACTCTGAC TCCTAAGGTCACGTGTGTTGTGGTAGACATCA GCAAGGATGATCCCGAGGTCCAGTTCAGCTGG TTTGTAGATGATGTGGAGGTGCACACAGCTCA GACGCAACCCCGGGAGGAGCAGTTCAACAGCA CTTTCCGCTCAGTCAGTGAACTTCCCATCATGC ACCAGGACTGGCTCAATGGCAAGGAGTTCAAA TGCAGGGTCAACAGTGCAGCTTTCCCTGCCCCC ATCGAGAAAACCATCTCCAAAACCAAAGGCAG ACCGAAGGCTCCACAGGTGTACACCATTCCAC CTCCCAAGGAGCAGATGGCCAAGGATAAAGTC AGTCTGACCTGCATGATAACAGACTTCTTCCCT GAAGACATTACTGTGGAGTGGCAGTGGAATGG GCAGCCAGCGGAGAACTACAAGAACACTCAGC CCATCATGAACACGAATGGCTCTTACTTCGTCT ACAGCAAGCTCAATGTGCAGAAGAGCAACTGG GAGGCAGGAAATACTTTCACCTGCTCTGTGTTA CATGAGGGCCTGCACAACCACCATACTGAGAA GAGCCTCTCCCACTCTCCTGGTAAATGA | 1054 |
| SM1B222 | pDR000028068 | ATGGCTTGGGTGTGGACCTTGCTATTCCTGATG GCAGCTGCCCAAAGTATACAGGCCGAGGTTCA GCTGCAGCAGTCTGGGGCTATGCTGGCAAGGC CTGGGGCTTCAGTGACGATGTCCTGCAAGGCT TCTGGCTACACCTTTACCGATTACTGGATGCAC TGGGTAAGACAGGGGCCTGGACAGGGTCTGGA ATGGATTGGCGCTATTTTTCCTGGAAATAGTGA TACTACCTACAATCAGAAATTCAGGGGCAAGG CCAAACTGACTGCAGTCACATCTGCCATCACT GCCTACATGGAGGTCAGCAGCCTGACAAATAT TGACTCTGCGGTCTATTACTGTACGGTAACTGA ACTTGACTACTGGGGCCAAGGCACCACTCTCA CAGTCTCCTCAGCCAAAACGACACCCCCATCT GTCTATCCACTGGCCCCTGGATCTGCTGCCCAA ACTAACTCCATGGTGACCCTGGGATGCCTGGT CAAGGGCTATTTCCCTGAGCCAGTGACAGTGA CCTGGAACTCTGGATCCCTGTCCAGCGGTGTGC ACACCTTCCCAGCTGTCCTGGAGTCTGACCTCT ACACTCTGAGCAGCTCAGTGACTGTCCCCTCCA GCCCTCGGCCCAGCGAGACCGTCACCTGCAAC GTTGCCCACCCGGCCAGCAGCACCAAGGTGGA CAAGAAAATTGTGCCCAGGGATTGTGGTTGTA AGCCTTGCATATGTACAGTCCCAGAAGTATCA TCTGTCTTCATCTTCCCCCCAAAGCCCAAGGAT GTGCTCACCATTACTCTGACTCCTAAGGTCACG TGTGTTGTGGTAGACATCAGCAAGGATGATCC CGAGGTCCAGTTCAGCTGGTTTGTAGATGATGT GGAGGTGCACACAGCTCAGACGCAACCCCGGG AGGAGCAGTTCAACAGCACTTTCCGCTCAGTC AGTGAACTTCCCATCATGCACCAGGACTGGCT CAATGGCAAGGAGTTCAAATGCAGGGTCAACA | 1055 |

TABLE 35-continued

LukD Antibody Heavy Chain Primary Transcripts

| mAB/Fab name | Construct ID | Heavy Chain Primary Transcript | SEQ ID NO: |
|---|---|---|---|
| | | GTGCAGCTTTCCCTGCCCCCATCGAGAAAACC ATCTCCAAAACCAAAGGCAGACCGAAGGCTCC ACAGGTGTACACCATTCCACCTCCCAAGGAGC AGATGGCCAAGGATAAAGTCAGTCTGACCTGC ATGATAACAGACTTCTTCCCTGAAGACATTACT GTGGAGTGGCAGTGGAATGGGCAGCCAGCGG AGAACTACAAGAACACTCAGCCCATCATGAAC ACGAATGGCTCTTACTTCGTCTACAGCAAGCTC AATGTGCAGAAGAGCAACTGGGAGGCAGGAA ATACTTTCACCTGCTCTGTGTTACATGAGGGCC TGCACAACCACCATACTGAGAAGAGCCTCTCC CACTCTCCTGGTAAATGA | |
| SM1B223 | pDR000028069 | ATGGCTTGGGTGTGGACCTTGCTATTCCTGATG GCAGCTGCCCAAAGTATACAGGCCGAGGTTCA GCTGCAGCAGTCTGGGGCTGACCTTGTGATGC CTGGGACTTCAATGAAGCTGTCCTGCAAGGCT TCTGGCTACACATTCACTGACTACTGGATTCAC TGGGTGAAGCAGGGGCCTGGACAAGGCCTTGA GTGGATCGGAGCGATTGATACTTCGGATAGTT ATATTAATTACAATCAAAAGTTCACGGACAAG GCCACATTGACCGTTGACGAATCCTCCAGCAC AGCCTACATGCACCTCAGCAGCCTGACATCTG AGGACTCTGCGGTCTATTATTGTGCAAGGGAC TACGGCTACGCTATGGACTACTGGGGTCAAGG AACCTCAGTCACCGTCTCCTCAGCCAAAACGA CACCCCCATCTGTCTATCCACTGGCCCCTGGAT CTGCTGCCCAAACTAACTCCATGGTGACCCTG GGATGCCTGGTCAAGGGCTATTTCCCTGAGCC AGTGACAGTGACCTGGAACTCTGGATCCCTGT CCAGCGGTGTGCACACCTTCCCAGCTGTCCTGG AGTCTGACCTCTACACTCTGAGCAGCTCAGTG ACTGTCCCCTCCAGCCCTCGGCCCAGCGAGAC CGTCACCTGCAACGTTGCCCACCCGGCCAGCA GCACCAAGGTGGACAAGAAAATTGTGCCCAGG GATTGTGGTTGTAAGCCTTGCATATGTACAGTC CCAGAAGTATCATCTGTCTTCATCTTCCCCCCA AAGCCCAAGGATGTGCTCACCATTACTCTGAC TCCTAAGGTCACGTGTGTTGTGGTAGACATCA GCAAGGATGATCCCGAGGTCCAGTTCAGCTGG TTTGTAGATGATGTGGAGGTGCACACAGCTCA GACGCAACCCCGGGAGGAGCAGTTCAACAGCA CTTTCCGCTCAGTCAGTGAACTTCCCATCATGC ACCAGGACTGGCTCAATGGCAAGGAGTTCAAA TGCAGGGTCAACAGTGCAGCTTTCCCTGCCCCC ATCGAGAAAACCATCTCCAAAACCAAAGGCAG ACCGAAGGCTCCACAGGTGTACACCATTCCAC CTCCCAAGGAGCAGATGGCCAAGGATAAAGTC AGTCTGACCTGCATGATAACAGACTTCTTCCCT GAAGACATTACTGTGGAGTGGCAGTGGAATGG GCAGCCAGCGGAGAACTACAAGAACACTCAGC CCATCATGAACACGAATGGCTCTTACTTCGTCT ACAGCAAGCTCAATGTGCAGAAGAGCAACTGG GAGGCAGGAAATACTTTCACCTGCTCTGTGTTA CATGAGGGCCTGCACAACCACCATACTGAGAA GAGCCTCTCCCACTCTCCTGGTAAATGA | 1056 |
| SM1B224 | pDR000028070 | ATGGCTTGGGTGTGGACCTTGCTATTCCTGATG GCAGCTGCCCAAAGTATACAGGCCCAGGTCCA ACTGCAGCAGCCTGGGGCTGAGCTTGTGATGC CTGGGTCTTCAGTGAAGATGTCCTGCAAGGCTT CTGGCTACACATTCACTGATTACTGGATGCACT GGGTGAAGCAGAGGCCGGGACAAGGCCTTGA GTGGATCGGAGCGATTGATGCTTCTGATAGTT ATACTAGCTACGATCAAAAGTTCAAGGGCAAG GCCACATTGACTGTTGACGATTCCTCCAGCACA GCCTACATTCACCTCAACAGCCTGACATCTGA GGACTCTGCGGTCTATTACTGTGCAAGAGACTT CGGCTATGCTATGGACTACTGGGGTCAAGGAA CCTCAGTCACCGTCTCCTCAGCCAAAACGACA CCCCCATCTGTCTATCCACTGGCCCCTGGATCT GCTGCCCAAACTAACTCCATGGTGACCCTGGG ATGCCTGGTCAAGGGCTATTTCCCTGAGCCAGT GACAGTGACCTGGAACTCTGGATCCCTGTCCA GCGGTGTGCACACCTTCCCAGCTGTCCTGGAGT | 1057 |

TABLE 35-continued

LukD Antibody Heavy Chain Primary Transcripts

| mAB/Fab name | Construct ID | Heavy Chain Primary Transcript | SEQ ID NO: |
|---|---|---|---|
| | | CTGACCTCTACACTCTGAGCAGCTCAGTGACTG<br>TCCCCTCCAGCCCTCGGCCCAGCGAGACCGTC<br>ACCTGCAACGTTGCCCACCCGGCCAGCAGCAC<br>CAAGGTGGACAAGAAAATTGTGCCCAGGGATT<br>GTGGTTGTAAGCCTTGCATATGTACAGTCCCAG<br>AAGTATCATCTGTCTTCATCTTCCCCCCAAAGC<br>CCAAGGATGTGCTCACCATTACTCTGACTCCTA<br>AGGTCACGTGTGTTGTGGTAGACATCAGCAAG<br>GATGATCCCGAGGTCCAGTTCAGCTGGTTTGTA<br>GATGATGTGGAGGTGCACACAGCTCAGACGCA<br>ACCCCGGGAGGAGCAGTTCAACAGCACTTTCC<br>GCTCAGTCAGTGAACTTCCCATCATGCACCAG<br>GACTGGCTCAATGGCAAGGAGTTCAAATGCAG<br>GGTCAACAGTGCAGCTTTCCCTGCCCCCATCGA<br>GAAAACCATCTCCAAAACCAAAGGCAGACCGA<br>AGGCTCCACAGGTGTACACCATTCCACCTCCC<br>AAGGAGCAGATGGCCAAGGATAAAGTCAGTCT<br>GACCTGCATGATAACAGACTTCTTCCCTGAAG<br>ACATTACTGTGGAGTGGCAGTGGAATGGGCAG<br>CCAGCGGAGAACTACAAGAACACTCAGCCCAT<br>CATGAACACGAATGGCTCTTACTTCGTCTACAG<br>CAAGCTCAATGTGCAGAAGAGCAACTGGGAGG<br>CAGGAAATACTTTCACCTGCTCTGTGTTACATG<br>AGGGCCTGCACAACCACCATACTGAGAAGAGC<br>CTCTCCCACTCTCCTGGTAAATGA | |
| SM1B225 | pDR000028071 | ATGGCTTGGGTGTGGACCTTGCTATTCCTGATG<br>GCAGCTGCCCAAAGTATACAGGCCGAGGTTCA<br>GCTGCAGCAGTCTGGGGGAGGCTTAGTGAAGC<br>CTGGAGGGTCCCTGAAACTCTCCTGTGCAGCCT<br>CTGGATTCACTTTCAGTAGCTATGCCATGTCTT<br>GGGTTCGCCAGACTCCGGAGAAGAGGCTGGAG<br>TGGGTCGCAACCATTACTGGTGGTGGTACTTAC<br>ACCTACTATCTAGACAGTGTGAAGGGTCGATT<br>CACCATCTCCAGAGACAATGCCAAGACCTCCC<br>TGTACCTGCAAATGAGCAGTCTGAGGTCGGAG<br>GACACGGCCATGTATTACTGTGCAAGACATCG<br>GGATGGTAACTACGGGTGCTTCGATGTCTGGG<br>GCGCAGGGACCACGGTCACCGTCTCCTCAGCC<br>AAAACGACACCCCCATCTGTCTATCCACTGGC<br>CCCTGGATCTGCTGCCCAAACTAACCCCATGGT<br>GACCCTGGGATGCCTGGTCAAGGGCTATTTCC<br>CTGAGCCAGTGACAGTGACCTGGAACTCTGGA<br>TCCCTGTCCAGCGGTGTGCACACCTTCCCAGCT<br>GTCCTGGAGTCTGACCTCTACACTCTGAGCAGC<br>TCAGTGACTGTCCCCTCCAGCCCTCGGCCCAGC<br>GAGACCGTCACCTGCAACGTTGCCCACCCGGC<br>CAGCAGCACCAAGGTGGACAAGAAAATTGTGC<br>CCAGGGATTGTGGTTGTAAGCCTTGCATATGTA<br>CAGTCCCAGAAGTATCATCTGTCTTCATCTTCC<br>CCCCAAAGCCCAAGGATGTGCTCACCATTACT<br>CTGACTCCTAAGGTCACGTGTGTTGTGGTAGAC<br>ATCAGCAAGGATGATCCCGAGGTCCAGTTCAG<br>CTGGTTTGTAGATGATGTGGAGGTGCACACAG<br>CTCAGACGCAACCCCGGGAGGAGCAGTTCAAC<br>AGCACTTTCCGCTCAGTCAGTGAACTTCCCATC<br>ATGCACCAGGACTGGCTCAATGGCAAGGAGTT<br>CAAATGCAGGGTCAACAGTGCAGCTTTCCCTG<br>CCCCCATCGAGAAAACCATCTCCAAAACCAAA<br>GGCAGACCGAAGGCTCCACAGGTGTACACCAT<br>TCCACCTCCCAAGGAGCAGATGGCCAAGGATA<br>AAGTCAGTCTGACCTGCATGATAACAGACTTC<br>TTCCCTGAAGACATTACTGTGGAGTGGCAGTG<br>GAATGGGCAGCCAGCGGAGAACTACAAGAAC<br>ACTCAGCCCATCATGAACACGAATGGCTCTTA<br>CTTCGTCTACAGCAAGCTCAATGTGCAGAAGA<br>GCAACTGGGAGGCAGGAAATACTTTCACCTGC<br>TCTGTGTTACATGAGGGCCTGCACAACCACCA<br>TACTGAGAAGAGCCTCTCCCACTCTCCTGGTAA<br>ATGA | 1058 |
| SM1B226 | pDR000028072 | ATGGCTTGGGTGTGGACCTTGCTATTCCTGATG<br>GCAGCTGCCCAAAGTATACAGGCCGAGGTTCA<br>GCTGCAGCAGTCTGGGGCTGAGCTTGTGATGC<br>CTGGGGCTTCAGTGAAGATGTCCTGCAAGGCT | 1059 |

TABLE 35-continued

LukD Antibody Heavy Chain Primary Transcripts

| mAB/Fab name | Construct ID | Heavy Chain Primary Transcript | SEQ ID NO: |
|---|---|---|---|
| | | TCTGGTTACACATTCACTGACTACTGGATGCAC TGGGTGCTGCAGAGGCCTGGACAAGGCCTTGA GTGGATCGGAGCGATTGATACTTCTGATAGTT ATACTACCTACAATCAAAAATTCAAGGGCAAG GCCACATTGACTGTAGACGAATCCTCCAGCAC GGCCTACATGCTGCTCAGCAGCCTGACATCTG AGGACTCTGCGGTCTATTACTGTGCAAGAGAC TACGGCTATGCTATGGACTACTGGGGTCAAGG ATCCTCAGTCACCGTCTCCTCAGCCAAAACGA CACCCCCATCTGTCTATCCACTGGCCCCTGGAT CTGCTGCCCAAACTAACTCCATGGTGACCCTG GGATGCCTGGTCAAGGGCTATTTCCCTGAGCC AGTGACAGTGACCTGGAACTCTGGATCCCTGT CCAGCGGTGTGCACACCTTCCCAGCTGTCCTGG AGTCTGACCTCTACACTCTGAGCAGCTCAGTG ACTGTCCCCTCCAGCCCTCGGCCCAGCGAGAC CGTCACCTGCAACGTTGCCCACCCGGCCAGCA GCACCAAGGTGGACAAGAAAATTGTGCCCAGG GATTGTGGTTGTAAGCCTTGCATATGTACAGTC CCAGAAGTATCATCTGTCTTCATCTTCCCCCCA AAGCCCAAGGATGTGCTCACCATTACTCTGAC TCCTAAGGTCACGTGTGTTGTGGTAGACATCA GCAAGGATGATCCCGAGGTCCAGTTCAGCTGG TTTGTAGATGATGTGGAGGTGCACACAGCTCA GACGCAACCCCGGGAGGAGCAGTTCAACAGCA CTTTCCGCTCAGTCAGTGAACTTCCCATCATGC ACCAGGACTGGCTCAATGGCAAGGAGTTCAAA TGCAGGGTCAACAGTGCAGCTTTCCCTGCCCCC ATCGAGAAAACCATCTCCAAAACCAAAGGCAG ACCGAAGGCTCCACAGGTGTACACCATTCCAC CTCCCAAGGAGCAGATGGCCAAGGATAAAGTC AGTCTGACCTGCATGATAACAGACTTCTTCCCT GAAGACATTACTGTGGAGTGGCAGTGGAATGG GCAGCCAGCGGAGAACTACAAGAACACTCAGC CCATCATGAACACGAATGGCTCTTACTTCGTCT ACAGCAAGCTCAATGTGCAGAAGAGCAACTGG GAGGCAGGAAATACTTTCACCTGCTCTGTGTTA CATGAGGGCCTGCACAACCACCATACTGAGAA GAGCCTCTCCCACTCTCCTGGTAAATGA | |
| SM1B227 | pDR000028073 | ATGGCTTGGGTGTGGACCTTGCTATTCCTGATG GCAGCTGCCCAAAGTATACAGGCCGAGTTCCA GCTGCAGCAGTCTGGACCTGAGCTGGTAAAGC CTGGGGCTTCAGTGAAGATGTCCTGCAAGGCT TCTGGATACACATTCACTAGCTATTTTATACAC TGGGTGAAGCAGAAGCCTGGACAGGGCCTTGA GTGGATTGGATTTATTAATCCTTACAATGCTGA TACTAACTACAATGAGAAATTCAAAGGCAAGG CCACACTGACTTCAGACAAATCCTCCAGCACA GCCTACATGGAGCTCAGCAGCCTGACCTCTGA GGACTCTGCGGTCTATTACTGTACTCCGAGTGC TATGGACTACTGGGGTCAAGGAACCTCAGTCA CCGTCTCCTCAGCCAAAACGACACCCCCATCT GTCTATCCACTGGCCCCTGGATCTGCTGCCCAA ACTAACTCCATGGTGACCCTGGGATGCCTGGT CAAGGGCTATTTCCCTGAGCCAGTGACAGTGA CCTGGAACTCTGGATCCCTGTCCAGCGGTGTGC ACACCTTCCCAGCTGTCCTGGAGTCTGACCTCT ACACTCTGAGCAGCTCAGTGACTGTCCCCTCCA GCCCTCGGCCCAGCGAGACCGTCACCTGCAAC GTTGCCCACCCGGCCAGCAGCACCAAGGTGGA CAAGAAAATTGTGCCCAGGGATTGTGGTTGTA AGCCTTGCATATGTACAGTCCCAGAAGTATCA TCTGTCTTCATCTTCCCCCCAAAGCCCAAGGAT GTGCTCACCATTACTCTGACTCCTAAGGTCACG TGTGTTGTGGTAGACATCAGCAAGGATGATCC CGAGGTCCAGTTCAGCTGGTTTGTAGATGATGT GGAGGTGCACACAGCTCAGACGCAACCCCGGG AGGAGCAGTTCAACAGCACTTTCCGCTCAGTC AGTGAACTTCCCATCATGCACCAGGACTGGCT CAATGGCAAGGAGTTCAAATGCAGGGTCAACA GTGCAGCTTTCCCTGCCCCCATCGAGAAAACC ATCTCCAAAACCAAAGGCAGACCGAAGGCTCC ACAGGTGTACACCATTCCACCTCCCAAGGAGC AGATGGCCAAGGATAAAGTCAGTCTGACCTGC | 1060 |

TABLE 35-continued

LukD Antibody Heavy Chain Primary Transcripts

| mAB/Fab name | Construct ID | Heavy Chain Primary Transcript | SEQ ID NO: |
|---|---|---|---|
| | | ATGATAACAGACTTCTTCCCTGAAGACATTACT GTGGAGTGGCAGTGGAATGGGCAGCCAGCGG AGAACTACAAGAACACTCAGCCCATCATGAAC ACGAATGGCTCTTACTTCGTCTACAGCAAGCTC AATGTGCAGAAGAGCAACTGGGAGGCAGGAA ATACTTTCACCTGCTCTGTGTTACATGAGGGCC TGCACAACCACCATACTGAGAAGAGCCTCTCC CACTCTCCTGGTAAATGA | |
| SM1B228 | pDR000028074 | ATGGCTTGGGTGTGGACCTTGCTATTCCTGATG GCAGCTGCCCAAAGTATACAGGCCCAGGTTCA GCTGCAGCAGTCTGGGGCTGAGCTTGTGATGC CTGGGGCTTCAGTGAAGATGTCCTGCAAGGCT TCTGGCTACACATTCACTGACTACTGGATGCAC TGGGTGAAGCAGAGGCCTGGACAAGGCCTTGA GTGGATCGGAGCGATTGATACTTCTGATAGTT ATACTACCTACAATCAAAAGTTCAAGGGCAAG GCCACATTGACTGTAGACGAATCCTCCAGCAC AGCCTACATGCAGCTCAGCAGCCTGACATCTG AGGACTCTGCGGTCTATTACTGTGCAAGGGAC TACGGCTACGCTATGGACTACTGGGGTCAAGG AACCTCAGTCACCGTCTCCTCAGCCAAAACGA CACCCCCATCTGTCTATCCACTGGCCCCTGGAT CTGCTGCCCAAACTAACTCCATGGTGACCCTG GGATGCCTGGTCAAGGGCTATTTCCCTGAGCC AGTGACAGTGACCTGGAACTCTGGATCCCTGT CCAGCGGTGTGCACACCTTCCCAGCTGTCCTGG AGTCTGACCTCTACACTCTGAGCAGCTCAGTG ACTGTCCCCTCCAGCCCTCGGCCCAGCGAGAC CGTCACCTGCAACGTTGCCCACCCGGCCAGCA GCACCAAGGTGGACAAGAAAATTGTGCCCAGG GATTGTGGTTGTAAGCCTTGCATATGTACAGTC CCAGAAGTATCATCTGTCTTCATCTTCCCCCCA AAGCCCAAGGATGTGCTCACCATTACTCTGAC TCCTAAGGTCACGTGTGTTGTGGTAGACATCA GCAAGGATGATCCCGAGGTCCAGTTCAGCTGG TTTGTAGATGATGTGGAGGTGCACACAGCTCA GACGCAACCCCGGGAGGAGCAGTTCAACAGCA CTTTCCGCTCAGTCAGTGAACTTCCCATCATGC ACCAGGACTGGCTCAATGGCAAGGAGTTCAAA TGCAGGGTCAACAGTGCAGCTTTCCCTGCCCCC ATCGAGAAAACCATCTCCAAAACCAAAGGCAG ACCGAAGGCTCCACAGGTGTACACCATTCCAC CTCCCAAGGAGCAGATGGCCAAGGATAAAGTC AGTCTGACCTGCATGATAACAGACTTCTTCCCT GAAGACATTACTGTGGAGTGGCAGTGGAATGG GCAGCCAGCGGAGAACTACAAGAACACTCAGC CCATCATGAACACGAATGGCTCTTACTTCGTCT ACAGCAAGCTCAATGTGCAGAAGAGCAACTGG GAGGCAGGAAATACTTTCACCTGCTCTGTGTTA CATGAGGGCCTGCACAACCACCATACTGAGAA GAGCCTCTCCCACTCTCCTGGTAAATGA | 1061 |

TABLE 36

LukD Antibody Light Chain CDSs

| mAB/Fab name | Construct ID | Light Chain CDS | SEQ ID NO: |
|---|---|---|---|
| SM1B221 | pDR000028075 | CAAATTGTTCTCACCCAGTCTCCAGCAATCATG TCTGCATCTCCAGGGGAGAAGGTCACCATAAC CTGCAGTGCCAGCTTAAGTGTCAGTTACATGCA CTGGTTCCAGCAGAAGCCAGGCACTTCTCCCA AACTCTGGATTTATAGCGCTTCCAACCTGGCTT CTGGAGTCCCTGCTCGCTTCAGTGGCAGTGGAT CTGGGACCTCTTACTCTCTCACAATCAGCCGAA TGGAGGCTGAAGATGCTGCCACTTATTACTGCC AGCAAAGGAGTAGTTACCCATTCACGTTCGGC TCGGGGACAAAGTTGGAAATAAAACGGGCTGA TGCTGCACCAACTGTATCCATCTTCCCACCATC CAGTGAGCAGTTAACATCTGGAGGTGCCTCAG | 1062 |

TABLE 36-continued

LukD Antibody Light Chain CDSs

| mAB/Fab name | Construct ID | Light Chain CDS | SEQ ID NO: |
|---|---|---|---|
| | | TCGTGTGCTTCTTGAACAACTTCTACCCCAAAG<br>ACATCAATGTCAAGTGGAAGATTGATGGCAGT<br>GAACGACAAAATGGCGTCCTGAACAGTTGGAC<br>TGATCAGGACAGCAAAGACAGCACCTACAGCA<br>TGAGCAGCACCCTCACGTTGACCAAGGACGAG<br>TATGAACGACATAACAGCTATACCTGTGAGGC<br>CACTCACAAGACATCAACTTCACCCATTGTCAA<br>GAGCTTCAACAGGAATGAGTGT | |
| SM1B222 | pDR000028076 | GATGTTGTGATGACCCAAACTCCACTCTCCCTG<br>CCTGTCAGTCTTGGAGATCAAGCCTCCATCTCT<br>TGCAGATCTAGTCAGAGCCTTATACACAATGA<br>TGGAAACACCTATTTACATTGGTACCTCCAGAA<br>GCCAGGCCAGTCTCCAAAGCTCCTGATCTACA<br>AAGTTTCCAACCGATTTTCTGGGGTCCCAGACA<br>GGTTCAGTGGCAGTGGATCAGGGACAGATTTC<br>ACAGTCAAGATCAGCAGAGTGGAGGCTGAGGA<br>TCTGGGAGTTTATTTCTGCTCTCAAAGTACACA<br>TGTTCCGTTCACGTTCGGTGCTGGGACCAAGCT<br>GGAGCTGAAACGGGCTGATGCTGCACCAACTG<br>TATCCATCTTCCCACCATCCAGTGAGCAGTTAA<br>CATCTGGAGGTGCCTCAGTCGTGTGCTTCTTGA<br>ACAACTTCTACCCCAAAGACATCAATGTCAAG<br>TGGAAGATTGATGGCAGTGAACGACAAAATGG<br>CGTCCTGAACAGTTGGACTGATCAGGACAGCA<br>AAGACAGCACCTACAGCATGAGCAGCACCCTC<br>ACGTTGACCAAGGACGAGTATGAACGACATAA<br>CAGCTATACCTGTGAGGCCACTCACAAGACAT<br>CAACTTCACCCATTGTCAAGAGCTTCAACAGG<br>AATGAGTGT | 1063 |
| SM1B223 | pDR000028077 | CAAATTGTTCTCTCCCAGTCTCCAGCAATCATG<br>TCTGCATCTCCAGGGGAGAAGGTCACCATAAC<br>CTGCAGTGCCAGCTTAAGTGTCAGTTTCATGCA<br>CTGGTTCCAGCAGAAGCCAGGCACTTCTCCCA<br>AACTCTGGATTTATAGCGCTTCCAACCTGGCTT<br>CTGGAGTCCCTGCTCGCTTCAGTGGCAGTGGAT<br>CTGGGACCTCTTACTCTCTCACAATCAGCCGAA<br>TGGAGGCTGAAGATGCTGCCACTTATTACTGCC<br>AGCAAAGGAGTAGCTACCCATTCACGTTCGGC<br>TCGGGGACAAAGTTGGAAATAAAACGGGCTGA<br>TGCTGCACCAACTGTATCCATCTTCCCACCATC<br>CAGTGAGCAGTTAACATCTGGAGGTGCCTCAG<br>TCGTGTGCTTCTTGAACAACTTCTACCCCAAAG<br>ACATCAATGTCAAGTGGAAGATTGATGGCAGT<br>GAACGACAAAATGGCGTCCTGAACAGTTGGAC<br>TGATCAGGACAGCAAAGACAGCACCTACAGCA<br>TGAGCAGCACCCTCACGTTGACCAAGGACGAG<br>TATGAACGACATAACAGCTATACCTGTGAGGC<br>CACTCACAAGACATCAACTTCACCCATTGTCAA<br>GAGCTTCAACAGGAATGAGTGT | 1064 |
| SM1B224 | pDR000028078 | CAAATTGTTCTCACCCAGTCTCCAGCAATCATG<br>TCTGCATCTCCAGGGGAGAAGGTCACCATAAC<br>CTGCAGTGCCAGCTCAAGTGTAAGTTTCATGCA<br>CTGGTTCCAGCAGAAGCCAGGCACTTCTCCCA<br>AACTCTGGATTTATAGCACATCCAACCTGGCTT<br>CTGGAGTCCCTGCTCGCTTCAGTGGCAGTGGAT<br>CTGGGACCTCTTACTCTCTCACAATCAGCCGAA<br>TGGAGGCTGAAGATGCTGCCACTTATTACTGCC<br>AGCAAAGGAGTACTTACCCATACACGTTCGGA<br>GGGGGGACCAAGATGGAAATAAAACGGGCTG<br>ATGCTGCACCAACTGTATCCATCTTCCCACCAT<br>CCAGTGAGCAGTTAACATCTGGAGGTGCCTCA<br>GTCGTGTGCTTCTTGAACAACTTCTACCCCAAA<br>GACATCAATGTCAAGTGGAAGATTGATGGCAG<br>TGAACGACAAAATGGCGTCCTGAACAGTTGGA<br>CTGATCAGGACAGCAAAGACAGCACCTACAGC<br>ATGAGCAGCACCCTCACGTTGACCAAGGACGA<br>GTATGAACGACATAACAGCTATACCTGTGAGG<br>CCACTCACAAGACATCAACTTCACCCATTGTCA<br>AGAGCTTCAACAGGAATGAGTGT | 1065 |
| SM1B225 | pDR000028079 | GATATTGTGCTAACTCAGTCTCCAGCAATCATG<br>TCTGCATCTCTAGGGGAACGGGTCACCATGAC | 1066 |

TABLE 36-continued

LukD Antibody Light Chain CDSs

| mAB/Fab name | Construct ID | Light Chain CDS | SEQ ID NO: |
|---|---|---|---|
| | | CTGCACTGCCAGCTCAAGTGTAAGTTCCAGTTA<br>CTTGCACTGGTACCAGCAGAAGCCAGGATCCT<br>CCCCCAAACTCTGGGTTTATAGCACATCCAACC<br>TGGCTTCTGGAGTCCCAGCTCGCTTCAGTGGCA<br>GTGGGTCTGGGTCCTCTTACTCTCTCACAATCA<br>GCAGCATGGAGCCTGAAGATACTGCCACTTAT<br>TACTGCCACCAGTATCATCGTTCCCCACAGACG<br>TTCGGTGGAGGCACCAAGCTGGAAATCAAACG<br>GGCTGATGCTGCACCAACTGTATCCATCTTCCC<br>ACCATCCAGTGAGCAGTTAACATCTGGAGGTG<br>CCTCAGTCGTGTGCTTCTTGAACAACTTCTACC<br>CCAAAGACATCAATGTCAAGTGGAAGATTGAT<br>GGCAGTGAACGACAAAATGGCGTCCTGAACAG<br>TTGGACTGATCAGGACAGCAAAGACAGCACCT<br>ACAGCATGAGCAGCACCCTCACGTTGACCAAG<br>GACGAGTATGAACGACATAACAGCTATACCTG<br>TGAGGCCACTCACAAGACATCAACTTCACCCA<br>TTGTCAAGAGCTTCAACAGGAATGAGTGT | |
| SM1B226 | pDR000028080 | CAAATTGTTCTCACCCAGTCTCCAGCAATCATG<br>TCTGCATCTCCAGGGGAGAAGGTCACCATTAC<br>CTGCAGTGCCAGCTCAAGTGTCAGTTTCATGCA<br>CTGGTTCCAGCAGAAGCCAGGCACTTCTCCCA<br>AACTCTGGATTTATAGCGCATCCAACCTGGCTT<br>CTGGAGTCCCTGCTCGCTTCAGTGGCAGTGGAT<br>CTGGGACCTCTTACTCTCTCACAATCAGCCGAA<br>TGGAGGCTGAAGATGCTGCCACTTATTACTGCC<br>AGCAAAGGAGTAGTTACCCATACACGTTCGGA<br>GGGGGGACCAAGCTGGAAATAAAGCGGGCTG<br>ATGCTGCACCAACTGTATCCATCTTCCCACCAT<br>CCAGTGAGCAGTTAACATCTGGAGGTGCCTCA<br>GTCGTGTGCTTCTTGAACAACTTCTACCCCAAA<br>GACATCAATGTCAAGTGGAAGATTGATGGCAG<br>TGAACGACAAAATGGCGTCCTGAACAGTTGGA<br>CTGATCAGGACAGCAAAGACAGCACCTACAGC<br>ATGAGCAGCACCCTCACGTTGACCAAGGACGA<br>GTATGAACGACATAACAGCTATACCTGTGAGG<br>CCACTCACAAGACATCAACTTCACCCATTGTCA<br>AGAGCTTCAACAGGAATGAGTGT | 1067 |
| SM1B227 | pDR000028081 | GATATTGTGCTAACTCAGTCTCCAGCAATCATG<br>TCTGCATCTCCAGGGGAAAAGGTCACCATGAC<br>CTGCAGTGCCAGCTCAAGTGTAAGTTACATGC<br>ACTGGTACCAGCAGAAGTCAAGCACCTCCCCC<br>AAACTCTGGATTTATGACACATCCAAACTGGCT<br>TCTGGAGTCCCAGGTCGCTTCAGTGGCAGTGG<br>GTCTGGAAACTCTTACTCTCTCACGATCAGCAG<br>CATGGAGGCTGAAGATGTTGCCACTTATTACTG<br>TTTTCAGGGGAGTGGGTACCCACTCACGTTCGG<br>CTCGGGGACAAAGTTGGAAATAAAACGGGCTG<br>ATGCTGCACCAACTGTATCCATCTTCCCACCAT<br>CCAGTGAGCAGTTAACATCTGGAGGTGCCTCA<br>GTCGTGTGCTTCTTGAACAACTTCTACCCCAAA<br>GACATCAATGTCAAGTGGAAGATTGATGGCAG<br>TGAACGACAAAATGGCGTCCTGAACAGTTGGA<br>CTGATCAGGACAGCAAAGACAGCACCTACAGC<br>ATGAGCAGCACCCTCACGTTGACCAAGGACGA<br>GTATGAACGACATAACAGCTATACCTGTGAGG<br>CCACTCACAAGACATCAACTTCACCCATTGTCA<br>AGAGCTTCAACAGGAATGAGTGT | 1068 |
| SM1B228 | pDR000028082 | CAAATTGTTCTCACCCAGTCTCCAGCAATCATG<br>TCTGCATCTCCAGGGGAGAAGGTCACCATAAC<br>CTGCAGTGCCAGCTCAAGTGTCAGTTACATGC<br>ACTGGTTCCAGCAGAAGCCAGGCACTTCTCCC<br>AAACTCTGGATTTATAGCGCATCCAACCTGGCT<br>TCTGGAGTCCCTGCTCGCTTCAGTGGCAGTGGA<br>TCTGGGACCTCTTACTCTCTCACAATCAGCCGA<br>ATGGAGGCTGAAGATGCTGCCACTTATTACTG<br>CCAGCAAAGGAGTAGTTACCCATTCACGTTCG<br>GCTCGGGGACAAAGTTGGAAATAAAACGGGCT<br>GATGCTGCACCAACTGTATCCATCTTCCCACCA<br>TCCAGTGAGCAGTTAACATCTGGAGGTGCCTC<br>AGTCGTGTGCTTCTTGAACAACTTCTACCCCAA<br>AGACATCAATGTCAAGTGGAAGATTGATGGCA | 1069 |

TABLE 36-continued

LukD Antibody Light Chain CDSs

| mAB/Fab name | Construct ID | Light Chain CDS | SEQ ID NO: |
|---|---|---|---|
| | | GTGAACGACAAAATGGCGTCCTGAACAGTTGG<br>ACTGATCAGGACAGCAAAGACAGCACCTACAG<br>CATGAGCAGCACCCTCACGTTGACCAAGGACG<br>AGTATGAACGACATAACAGCTATACCTGTGAG<br>GCCACTCACAAGACATCAACTTCACCCATTGTC<br>AAGAGCTTCAACAGGAATGAGTGT | |

TABLE 37

LukD Antibody Light Chain Primary Transcripts

| mAB/Fab name | Construct ID | Light Chain Primary Transcript | SEQ ID NO: |
|---|---|---|---|
| SM1B221 | pDR000028075 | ATGGAGACACATTCTCAGGTCTTTGTATACATG<br>TTGCTGTGGTTGTCTGGTGTCGAGGGCCAAATT<br>GTTCTCACCCAGTCTCCAGCAATCATGTCTGCA<br>TCTCCAGGGGAGAAGGTCACCATAACCTGCAG<br>TGCCAGCTTAAGTGTCAGTTACATGCACTGGTT<br>CCAGCAGAAGCCAGGCACTTCTCCCAAACTCT<br>GGATTTATAGCGCTTCCAACCTGGCTTCTGGAG<br>TCCCTGCTCGCTTCAGTGGCAGTGGATCTGGGA<br>CCTCTTACTCTCTCACAATCAGCCGAATGGAGG<br>CTGAAGATGCTGCCACTTATTACTGCCAGCAA<br>AGGAGTAGTTACCCATTCACGTTCGGCTCGGG<br>GACAAAGTTGGAAATAAAACGGGCTGATGCTG<br>CACCAACTGTATCCATCTTCCCACCATCCAGTG<br>AGCAGTTAACATCTGGAGGTGCCTCAGTCGTG<br>TGCTTCTTGAACAACTTCTACCCCAAAGACATC<br>AATGTCAAGTGGAAGATTGATGGCAGTGAACG<br>ACAAAATGGCGTCCTGAACAGTTGGACTGATC<br>AGGACAGCAAAGACAGCACCTACAGCATGAGC<br>AGCACCCTCACGTTGACCAAGGACGAGTATGA<br>ACGACATAACAGCTATACCTGTGAGGCCACTC<br>ACAAGACATCAACTTCACCCATTGTCAAGAGC<br>TTCAACAGGAATGAGTGTTAG | 1070 |
| SM1B222 | pDR000028076 | ATGGAGACACATTCTCAGGTCTTTGTATACATG<br>TTGCTGTGGTTGTCTGGTGTCGAGGGCGATGTT<br>GTGATGACCCAAACTCCACTCTCCCTGCCTGTC<br>AGTCTTGGAGATCAAGCCTCCATCTCTTGCAGA<br>TCTAGTCAGAGCCTTATACACAATGATGGAAA<br>CACCTATTTACATTGGTACCTCCAGAAGCCAGG<br>CCAGTCTCCAAAGCTCCTGATCTACAAAGTTTC<br>CAACCGATTTTCTGGGGTCCCAGACAGGTTCA<br>GTGGCAGTGGATCAGGGACAGATTTCACAGTC<br>AAGATCAGCAGAGTGGAGGCTGAGGATCTGGG<br>AGTTTATTTCTGCTCTCAAAGTACACATGTTCC<br>GTTCACGTTCGGTGCTGGGACCAAGCTGGAGC<br>TGAAACGGGCTGATGCTGCACCAACTGTATCC<br>ATCTTCCCACCATCCAGTGAGCAGTTAACATCT<br>GGAGGTGCCTCAGTCGTGTGCTTCTTGAACAAC<br>TTCTACCCCAAAGACATCAATGTCAAGTGGAA<br>GATTGATGGCAGTGAACGACAAAATGGCGTCC<br>TGAACAGTTGGACTGATCAGGACAGCAAAGAC<br>AGCACCTACAGCATGAGCAGCACCCTCACGTT<br>GACCAAGGACGAGTATGAACGACATAACAGCT<br>ATACCTGTGAGGCCACTCACAAGACATCAACT<br>TCACCCATTGTCAAGAGCTTCAACAGGAATGA<br>GTGTTAG | 1071 |
| SM1B223 | pDR000028077 | ATGGAGACACATTCTCAGGTCTTTGTATACATG<br>TTGCTGTGGTTGTCTGGTGTCGAGGGCCAAATT<br>GTTCTCTCCCAGTCTCCAGCAATCATGTCTGCA<br>TCTCCAGGGGAGAAGGTCACCATAACCTGCAG<br>TGCCAGCTTAAGTGTCAGTTTCATGCACTGGTT<br>CCAGCAGAAGCCAGGCACTTCTCCCAAACTCT<br>GGATTTATAGCGCTTCCAACCTGGCTTCTGGAG<br>TCCCTGCTCGCTTCAGTGGCAGTGGATCTGGGA<br>CCTCTTACTCTCTCACAATCAGCCGAATGGAGG<br>CTGAAGATGCTGCCACTTATTACTGCCAGCAA<br>AGGAGTAGCTACCCATTCACGTTCGGCTCGGG | 1072 |

TABLE 37-continued

LukD Antibody Light Chain Primary Transcripts

| mAB/Fab name | Construct ID | Light Chain Primary Transcript | SEQ ID NO: |
|---|---|---|---|
| | | GACAAAGTTGGAAATAAAACGGGCTGATGCTG<br>CACCAACTGTATCCATCTTCCCACCATCCAGTG<br>AGCAGTTAACATCTGGAGGTGCCTCAGTCGTG<br>TGCTTCTTGAACAACTTCTACCCCAAAGACATC<br>AATGTCAAGTGGAAGATTGATGGCAGTGAACG<br>ACAAAATGGCGTCCTGAACAGTTGGACTGATC<br>AGGACAGCAAAGACAGCACCTACAGCATGAGC<br>AGCACCCTCACGTTGACCAAGGACGAGTATGA<br>ACGACATAACAGCTATACCTGTGAGGCCACTC<br>ACAAGACATCAACTTCACCCATTGTCAAGAGC<br>TTCAACAGGAATGAGTGTTAG | |
| SM1B224 | pDR000028078 | ATGGAGACACATTCTCAGGTCTTTGTATACATG<br>TTGCTGTGGTTGTCTGGTGTCGAGGGCCAAATT<br>GTTCTCACCCAGTCTCCAGCAATCATGTCTGCA<br>TCTCCAGGGGAGAAGGTCACCATAACCTGCAG<br>TGCCAGCTCAAGTGTAAGTTTCATGCACTGGTT<br>CCAGCAGAAGCCAGGCACTTCTCCCAAACTCT<br>GGATTTATAGCACATCCAACCTGGCTTCTGGAG<br>TCCCTGCTCGCTTCAGTGGCAGTGGATCTGGGA<br>CCTCTTACTCTCTCACAATCAGCCGAATGGAGG<br>CTGAAGATGCTGCCACTTATTACTGCCAGCAA<br>AGGAGTACTTACCCATACACGTTCGGAGGGGG<br>GACCAAGATGGAAATAAAACGGGCTGATGCTG<br>CACCAACTGTATCCATCTTCCCACCATCCAGTG<br>AGCAGTTAACATCTGGAGGTGCCTCAGTCGTG<br>TGCTTCTTGAACAACTTCTACCCCAAAGACATC<br>AATGTCAAGTGGAAGATTGATGGCAGTGAACG<br>ACAAAATGGCGTCCTGAACAGTTGGACTGATC<br>AGGACAGCAAAGACAGCACCTACAGCATGAGC<br>AGCACCCTCACGTTGACCAAGGACGAGTATGA<br>ACGACATAACAGCTATACCTGTGAGGCCACTC<br>ACAAGACATCAACTTCACCCATTGTCAAGAGC<br>TTCAACAGGAATGAGTGTTAG | 1073 |
| SM1B225 | pDR000028079 | ATGGAGACACATTCTCAGGTCTTTGTATACATG<br>TTGCTGTGGTTGTCTGGTGTCGAGGGCGATATT<br>GTGCTAACTCAGTCTCCAGCAATCATGTCTGCA<br>TCTCTAGGGGAACGGGTCACCATGACCTGCAC<br>TGCCAGCTCAAGTGTAAGTTCCAGTTACTTGCA<br>CTGGTACCAGCAGAAGCCAGGATCCTCCCCCA<br>AACTCTGGGTTTATAGCACATCCAACCTGGCTT<br>CTGGAGTCCCAGCTCGCTTCAGTGGCAGTGGG<br>TCTGGGTCCTCTTACTCTCTCACAATCAGCAGC<br>ATGGAGCCTGAAGATACTGCCACTTATTACTGC<br>CACCAGTATCATCGTTCCCCACAGACGTTCGGT<br>GGAGGCACCAAGCTGGAAATCAAACGGGCTGA<br>TGCTGCACCAACTGTATCCATCTTCCCACCATC<br>CAGTGAGCAGTTAACATCTGGAGGTGCCTCAG<br>TCGTGTGCTTCTTGAACAACTTCTACCCCAAAG<br>ACATCAATGTCAAGTGGAAGATTGATGGCAGT<br>GAACGACAAAATGGCGTCCTGAACAGTTGGAC<br>TGATCAGGACAGCAAAGACAGCACCTACAGCA<br>TGAGCAGCACCCTCACGTTGACCAAGGACGAG<br>TATGAACGACATAACAGCTATACCTGTGAGGC<br>CACTCACAAGACATCAACTTCACCCATTGTCAA<br>GAGCTTCAACAGGAATGAGTGTTAG | 1074 |
| SM1B226 | pDR000028080 | ATGGAGACACATTCTCAGGTCTTTGTATACATG<br>TTGCTGTGGTTGTCTGGTGTCGAGGGCCAAATT<br>GTTCTCACCCAGTCTCCAGCAATCATGTCTGCA<br>TCTCCAGGGGAGAAGGTCACCATTACCTGCAG<br>TGCCAGCTCAAGTGTCAGTTTCATGCACTGGTT<br>CCAGCAGAAGCCAGGCACTTCTCCCAAACTCT<br>GGATTTATAGCGCATCCAACCTGGCTTCTGGAG<br>TCCCTGCTCGCTTCAGTGGCAGTGGATCTGGGA<br>CCTCTTACTCTCTCACAATCAGCCGAATGGAGG<br>CTGAAGATGCTGCCACTTATTACTGCCAGCAA<br>AGGAGTAGTTACCCATACACGTTCGGAGGGGG<br>GACCAAGCTGGAAATAAAGCGGGCTGATGCTG<br>CACCAACTGTATCCATCTTCCCACCATCCAGTG<br>AGCAGTTAACATCTGGAGGTGCCTCAGTCGTG<br>TGCTTCTTGAACAACTTCTACCCCAAAGACATC<br>AATGTCAAGTGGAAGATTGATGGCAGTGAACG<br>ACAAAATGGCGTCCTGAACAGTTGGACTGATC | 1075 |

TABLE 37-continued

LukD Antibody Light Chain Primary Transcripts

| mAB/Fab name | Construct ID | Light Chain Primary Transcript | SEQ ID NO: |
|---|---|---|---|
| | | AGGACAGCAAAGACAGCACCTACAGCATGAGC<br>AGCACCCTCACGTTGACCAAGGACGAGTATGA<br>ACGACATAACAGCTATACCTGTGAGGCCACTC<br>ACAAGACATCAACTTCACCCATTGTCAAGAGC<br>TTCAACAGGAATGAGTGTTAG | |
| SM1B227 | pDR000028081 | ATGGAGACACATTCTCAGGTCTTTGTATACATG<br>TTGCTGTGGTTGTCTGGTGTCGAGGGCGATATT<br>GTGCTAACTCAGTCTCCAGCAATCATGTCTGCA<br>TCTCCAGGGGAAAAGGTCACCATGACCTGCAG<br>TGCCAGCTCAAGTGTAAGTTACATGCACTGGT<br>ACCAGCAGAAGTCAAGCACCTCCCCCAAACTC<br>TGGATTTATGACACATCCAAACTGGCTTCTGGA<br>GTCCCAGGTCGCTTCAGTGGCAGTGGGTCTGG<br>AAACTCTTACTCTCTCACGATCAGCAGCATGGA<br>GGCTGAAGATGTTGCCACTTATTACTGTTTTCA<br>GGGGAGTGGGTACCCACTCACGTTCGGCTCGG<br>GGACAAAGTTGGAAATAAAACGGGCTGATGCT<br>GCACCAACTGTATCCATCTTCCCACCATCCAGT<br>GAGCAGTTAACATCTGGAGGTGCCTCAGTCGT<br>GTGCTTCTTGAACAACTTCTACCCCAAAGACAT<br>CAATGTCAAGTGGAAGATTGATGGCAGTGAAC<br>GACAAAATGGCGTCCTGAACAGTTGGACTGAT<br>CAGGACAGCAAAGACAGCACCTACAGCATGAG<br>CAGCACCCTCACGTTGACCAAGGACGAGTATG<br>AACGACATAACAGCTATACCTGTGAGGCCACT<br>CACAAGACATCAACTTCACCCATTGTCAAGAG<br>CTTCAACAGGAATGAGTGTTAG | 1076 |
| SM1B228 | pDR000028082 | ATGGAGACACATTCTCAGGTCTTTGTATACATG<br>TTGCTGTGGTTGTCTGGTGTCGAGGGCCAAATT<br>GTTCTCACCCAGTCTCCAGCAATCATGTCTGCA<br>TCTCCAGGGGAGAAGGTCACCATAACCTGCAG<br>TGCCAGCTCAAGTGTCAGTTACATGCACTGGTT<br>CCAGCAGAAGCCAGGCACTTCTCCCAAACTCT<br>GGATTTATAGCGCATCCAACCTGGCTTCTGGAG<br>TCCCTGCTCGCTTCAGTGGCAGTGGATCTGGGA<br>CCTCTTACTCTCTCACAATCAGCCGAATGGAGG<br>CTGAAGATGCTGCCACTTATTACTGCCAGCAA<br>AGGAGTAGTTACCCATTCACGTTCGGCTCGGG<br>GACAAAGTTGGAAATAAAACGGGCTGATGCTG<br>CACCAACTGTATCCATCTTCCCACCATCCAGTG<br>AGCAGTTAACATCTGGAGGTGCCTCAGTCGTG<br>TGCTTCTTGAACAACTTCTACCCCAAAGACATC<br>AATGTCAAGTGGAAGATTGATGGCAGTGAACG<br>ACAAAATGGCGTCCTGAACAGTTGGACTGATC<br>AGGACAGCAAAGACAGCACCTACAGCATGAGC<br>AGCACCCTCACGTTGACCAAGGACGAGTATGA<br>ACGACATAACAGCTATACCTGTGAGGCCACTC<br>ACAAGACATCAACTTCACCCATTGTCAAGAGC<br>TTCAACAGGAATGAGTGTTAG | 1077 |

TABLE 38

HlgA Antibody Heavy Chain CDSs

| mAB/Fab name | Construct ID | Heavy Chain CDS | SEQ ID NO: |
|---|---|---|---|
| SM1B215 | pDR000027230 | GAGGTTCAGCTGCAGCAGTCTGGGCCTGAGCT<br>GAAGAAGCCTGGAGAGACAGTCAAGATCTCCT<br>GCAAGACTTCTGGATATACCTTCACAATTTATG<br>GAATGAACTGGATGAAGCAGGCTCCAGGAAAG<br>GGTTTAAAGTGGATGGGCTGGATAAACACCTA<br>CACTGGAGAGCCAACATATGCTGATGACTTCA<br>AGGGACGGTTTGCCTTCTCTTTGGAAACCTCTG<br>CCAGCACTGCCTATTTGCAGATCAACAACCTCA<br>AAAATGAGGACACGGCTACATATTTCTGTGCA<br>AGATGCTACTATAAATACGAGGACTATGCTAT<br>GGACTACTGGGGTCAAGGAACCTCAGTCACCG<br>TCTCCTCAGCCAAAACGACACCCCCATCTGTCT<br>ATCCACTGGCCCCTGGATCTGCTGCCCAAACTA | 1078 |

TABLE 38-continued

H1qA Antibody Heavy Chain CDSs

| mAB/Fab name | Construct ID | Heavy Chain CDS | SEQ ID NO: |
|---|---|---|---|
| | | ACTCCATGGTGACCCTGGGATGCCTGGTCAAG GGCTATTTCCCTGAGCCAGTGACAGTGACCTG GAACTCTGGATCCCTGTCCAGCGGTGTGCACA CCTTCCCAGCTGTCCTGGAGTCTGACCTCTACA CTCTGAGCAGCTCAGTGACTGTCCCCTCCAGCC CTCGGCCCAGCGAGACCGTCACCTGCAACGTT GCCCACCCGGCCAGCAGCACCAAGGTGGACAA GAAAATTGTGCCCAGGGATTGTGGTTGTAAGC CTTGCATATGTACAGTCCCAGAAGTATCATCTG TCTTCATCTTCCCCCCAAAGCCCAAGGATGTGC TCACCATTACTCTGACTCCTAAGGTCACGTGTG TTGTGGTAGACATCAGCAAGGATGATCCCGAG GTCCAGTTCAGCTGGTTTGTAGATGATGTGGAG GTGCACACAGCTCAGACGCAACCCCGGGAGGA GCAGTTCAACAGCACTTTCCGCTCAGTCAGTGA ACTTCCCATCATGCACCAGGACTGGCTCAATG GCAAGGAGTTCAAATGCAGGGTCAACAGTGCA GCTTTCCCTGCCCCCATCGAGAAAACCATCTCC AAAACCAAAGGCAGACCGAAGGCTCCACAGGT GTACACCATTCCACCTCCCAAGGAGCAGATGG CCAAGGATAAAGTCAGTCTGACCTGCATGATA ACAGACTTCTTCCCTGAAGACATTACTGTGGAG TGGCAGTGGAATGGGCAGCCAGCGGAGAACTA CAAGAACACTCAGCCCATCATGAACACGAATG GCTCTTACTTCGTCTACAGCAAGCTCAATGTGC AGAAGAGCAACTGGGAGGCAGGAAATACTTTC ACCTGCTCTGTGTTACATGAGGGCCTGCACAAC CACCATACTGAGAAGAGCCTCTCCCACTCTCCT GGTAAA | |
| SM1B216 | pDR000027231 | GAAGTGAAGCTGGTGGAGTCTGGGGGAGGTTT AGTGAAGCCTGGAGGGTCCCTGAAACTCTCCT GTGCAGCCTCTGGGATTCACTTTCAGTAGCTATG CCATGTCTTGGGTTCGCCAGACTCCAGAAAAG AGGCTGGAGTGGGTCGCAGCCATTAATGGTAA TGGTGGTAGCACCTACTATCCAGACACTGTGA AGGACCGATTCACCATCTCCAGAGACAATGCC AAGAACACCCTTTACCTACAAATGAGCAGTCT GAGGTCTGAGGACACAGCCTTGTATTACTGTG CAAGACATAGGGCTGATGGTCCCTGGTTTACTT ACTGGGGCCAAGGGACTCTGGTCACTGTCTCT GCAGCCAAAACGACACCCCCATCTGTCTATCC ACTGGCCCCTGGATCTGCTGCCCAAACTAACCC CATGGTGACCCTGGGATGCCTGGTCAAGGGCT ATTTCCCTGAGCCAGTGACAGTGACCTGGAAC TCTGGATCCCTGTCCAGCGGTGTGCACACCTTC CCAGCTGTCCTGGAGTCTGACCTCTACACTCTG AGCAGCTCAGTGACTGTCCCCTCCAGCCCTCGG CCCAGCGAGACCGTCACCTGCAACGTTGCCCA CCCGGCCAGCAGCACCAAGGTGGACAAGAAA ATTGTGCCCAGGGATTGTGGTTGTAAGCCTTGC ATATGTACAGTCCCAGAAGTATCATCTGTCTTC ATCTTCCCCCCAAAGCCCAAGGATGTGCTCACC ATTACTCTGACTCCTAAGGTCACGTGTGTTGTG GTAGACATCAGCAAGGATGATCCCGAGGTCCA GTTCAGCTGGTTTGTAGATGATGTGGAGGTGC ACACAGCTCAGACGCAACCCCGGGAGGAGCAG TTCAACAGCACTTTCCGCTCAGTCAGTGAACTT CCCATCATGCACCAGGACTGGCTCAATGGCAA GGAGTTCAAATGCAGGGTCAACAGTGCAGCTT TCCCTGCCCCCATCGAGAAAACCATCTCCAAA ACCAAAGGCAGACCGAAGGCTCCACAGGTGTA CACCATTCCACCTCCCAAGGAGCAGATGGCCA AGGATAAAGTCAGTCTGACCTGCATGATAACA GACTTCTTCCCTGAAGACATTACTGTGGAGTGG CAGTGGAATGGGCAGCCAGCGGAGAACTACAA GAACACTCAGCCCATCATGAACACGAATGGCT CTTACTTCGTCTACAGCAAGCTCAATGTGCAGA AGAGCAACTGGGAGGCAGGAAATACTTTCACC TGCTCTGTGTTACATGAGGGCCTGCACAACCAC CATACTGAGAAGAGCCTCTCCCACTCTCCTGGT AAA | 1079 |
| SM1B217 | pDR000027921 | GAAGTGAAGCTGGTGGAAAGCGGCGGAGGCCT GGTGAAACCTGGCGGCAGCCTGAAGCTGAGCT | 1080 |

TABLE 38-continued

H1qA Antibody Heavy Chain CDSs

| mAB/Fab name | Construct ID | Heavy Chain CDS | SEQ ID NO: |
|---|---|---|---|
| | | GCGCCGCCAGCGGCTTCACCTTCAGCAACTAC GCCATGAGCTGGGTGCGCCAGACCCCCGAGAA GCGGCTGGAATGGGTGGCCAGCATCAGCAGAC GGGGCAGCACCTACTACCCCGACAGCGTGAAG GGCCGGTTCACCATCAGCCGGGACAACGCCCG GAACATCCTGTACCTGCAGATGAGCAGCCTGC GGAGCGAGGACACCGCCCTGTACTACTGCGCC ACCGTGTACTACGACAACCCTTGGTTTGTGTAC TGGGGCCAGGGCACCCTGGTGACAGTGTCCGC TGCCAAAACGACACCACCAAGTGTCTATCCAC TGGCCCCTGGATCTGCTGCCCAAACTAACTCCA TGGTGACCCTGGGATGCCTGGTCAAGGGCTAT TTCCCTGAGCCAGTGACAGTGACCTGGAACTCT GGATCCCTGTCCAGCGGTGTGCACACCTTCCCA GCTGTCCTGGAGTCTGACCTCTACACTCTGAGC AGCTCAGTGACTGTCCCCTCCAGCCCTCGGCCC AGCGAGACCGTCACCTGCAACGTTGCCCACCC GGCCAGCAGCACCAAGGTGGACAAGAAAATTG TGCCCAGGGATTGTGGTTGTAAGCCTTGCATAT GTACAGTCCCAGAAGTATCATCTGTCTTCATCT TCCCCCCAAAGCCCAAGGATGTGCTCACCATT ACTCTGACTCCTAAGGTCACGTGTGTTGTGGTA GACATCAGCAAGGATGATCCCGAGGTCCAGTT CAGCTGGTTTGTAGATGATGTGGAGGTGCACA CAGCTCAGACGCAACCCCGGGAGGAGCAGTTC AACAGCACTTTCCGCTCAGTCAGTGAACTTCCC ATCATGCACCAGGACTGGCTCAATGGCAAGGA GTTCAAATGCAGGGTCAACAGTGCAGCTTTCC CTGCCCCCATCGAGAAAACCATCTCCAAAACC AAAGGCAGACCGAAGGCTCCACAGGTGTACAC CATTCCACCTCCCAAGGAGCAGATGGCCAAGG ATAAAGTCAGTCTGACCTGCATGATAACAGAC TTCTTCCCTGAAGACATTACTGTGGAGTGGCAG TGGAATGGGCAGCCAGCGGAGAACTACAAGA ACACTCAGCCCATCATGAACACGAATGGCTCT TACTTCGTCTACAGCAAGCTCAATGTGCAGAA GAGCAACTGGGAGGCAGGAAATACTTTCACCT GCTCTGTGTTACATGAGGGCCTGCACAACCAC CATACTGAGAAGAGCCTCTCCCACTCTCCTGGT AAA | |
| SM1B218 | pDR000027922 | CAGATCCAGCTGGTGCAGAGCGGCCCTGAGCT GAAGAAACCCGGCGAGACAGTGAAGATCAGCT GCAAGACCAGCGGCTACACCTTCACCATCTAC GGCATGAACTGGACCAAGCAGGCCCCTGGCAA GGGCCTGAAGTGGATGGGCTGGATCAACACCT ACACCGGCGAGCCCACCTACGCCGACGACTTC AAGGGCAGATTCGCCTTCAGCCTGGAAACCAG CGCCAGCACCGCCTACCTGCAGATCAACAACC TGAAGAACGAGGACACCGCCACCTACTTTTGC GCCCGGTGCTACTATAAGTACGAGGACTACGC CATGGACTACTGGGGCCAGGGCACCAGCGTGA CCGTGTCCTCTGCCAAAACGACACCACCAAGT GTCTATCCACTGGCCCCTGGATCTGCTGCCCAA ACTAACTCCATGGTGACCCTGGGATGCCTGGTC AAGGGCTATTTCCCTGAGCCAGTGACAGTGAC CTGGAACTCTGGATCCCTGTCCAGCGGTGTGCA CACCTTCCCAGCTGTCCTGGAGTCTGACCTCTA CACTCTGAGCAGCTCAGTGACTGTCCCCTCCAG CCCTCGGCCCAGCGAGACCGTCACCTGCAACG TTGCCCACCCGGCCAGCAGCACCAAGGTGGAC AAGAAAATTGTGCCCAGGGATTGTGGTTGTAA GCCTTGCATATGTACAGTCCCAGAAGTATCATC TGTCTTCATCTTCCCCCCAAAGCCCAAGGATGT GCTCACCATTACTCTGACTCCTAAGGTCACGTG TGTTGTGGTAGACATCAGCAAGGATGATCCCG AGGTCCAGTTCAGCTGGTTTGTAGATGATGTGG AGGTGCACACAGCTCAGACGCAACCCCGGGAG GAGCAGTTCAACAGCACTTTCCGCTCAGTCAGT GAACTTCCCATCATGCACCAGGACTGGCTCAA TGGCAAGGAGTTCAAATGCAGGGTCAACAGTG CAGCTTTCCCTGCCCCCATCGAGAAAACCATCT CCAAAACCAAAGGCAGACCGAAGGCTCCACAG GTGTACACCATTCCACCTCCCAAGGAGCAGAT GGCCAAGGATAAAGTCAGTCTGACCTGCATGA | 1081 |

TABLE 38-continued

H1qA Antibody Heavy Chain CDSs

| mAB/Fab name | Construct ID | Heavy Chain CDS | SEQ ID NO: |
|---|---|---|---|
| | | TAACAGACTTCTTCCCTGAAGACATTACTGTGG<br>AGTGGCAGTGGAATGGGCAGCCAGCGGAGAA<br>CTACAAGAACACTCAGCCCATCATGAACACGA<br>ATGGCTCTTACTTCGTCTACAGCAAGCTCAATG<br>TGCAGAAGAGCAACTGGGAGGCAGGAAATACT<br>TTCACCTGCTCTGTGTTACATGAGGGCCTGCAC<br>AACCACCATACTGAGAAGAGCCTCTCCCACTC<br>TCCTGGTAAA | |
| SM1B219 | pDR000027923 | GACGTGAAGCTGGTGGAAAGCGGCGGAGGCCT<br>GGTGAAACCTGGCGGCAGCCTGAAGCTGAGCT<br>GCGCCGCCAGCGGCTTCACCTTCAGCAGCTAC<br>GCCATGAGCTGGGTGCGCCAGACCCCCGAGAA<br>GCGGCTGGAATGGGTGGCCGCCATCAACGGCA<br>ACGGCGGCAGCACCTACTACCCCGACACCGTG<br>AAGGACCGGTTCACCATCAGCCGGGACAACGC<br>CAAGAACACCCTGTACCTGCAGATGAGCAGCC<br>TGCGGAGCGAGGACACCGCCCTGTACTACTGC<br>GCCAGACACAGAGCCGACGGCCCCTGGTTCAC<br>ATACTGGGGCCAGGGCACCCTGGTGACAGTGT<br>CCGCTGCCAAAACGACACCACCAAGTGTCTAT<br>CCACTGGCCCCTGGATCTGCTGCCCAAACTAAC<br>TCCATGGTGACCCTGGGATGCCTGGTCAAGGG<br>CTATTTCCCTGAGCCAGTGACAGTGACCTGGA<br>ACTCTGGATCCCTGTCCAGCGGTGTGCACACCT<br>TCCCAGCTGTCCTGGAGTCTGACCTCTACACTC<br>TGAGCAGCTCAGTGACTGTCCCCTCCAGCCCTC<br>GGCCCAGCGAGACCGTCACCTGCAACGTTGCC<br>CACCCGGCCAGCAGCACCAAGGTGGACAAGAA<br>AATTGTGCCCAGGGATTGTGGTTGTAAGCCTTG<br>CATATGTACAGTCCCAGAAGTATCATCTGTCTT<br>CATCTTCCCCCCAAAGCCCAAGGATGTGCTCAC<br>CATTACTCTGACTCCTAAGGTCACGTGTGTTGT<br>GGTAGACATCAGCAAGGATGATCCCGAGGTCC<br>AGTTCAGCTGGTTTGTAGATGATGTGGAGGTG<br>CACACAGCTCAGACGCAACCCCGGGAGGAGCA<br>GTTCAACAGCACTTTCCGCTCAGTCAGTGAACT<br>TCCCATCATGCACCAGGACTGGCTCAATGGCA<br>AGGAGTTCAAATGCAGGGTCAACAGTGCAGCT<br>TTCCCTGCCCCCATCGAGAAAACCATCTCCAAA<br>ACCAAAGGCAGACCGAAGGCTCCACAGGTGTA<br>CACCATTCCACCTCCCAAGGAGCAGATGGCCA<br>AGGATAAAGTCAGTCTGACCTGCATGATAACA<br>GACTTCTTCCCTGAAGACATTACTGTGGAGTGG<br>CAGTGGAATGGGCAGCCAGCGGAGAACTACAA<br>GAACACTCAGCCCATCATGAACACGAATGGCT<br>CTTACTTCGTCTACAGCAAGCTCAATGTGCAGA<br>AGAGCAACTGGGAGGCAGGAAATACTTTCACC<br>TGCTCTGTGTTACATGAGGGCCTGCACAACCAC<br>CATACTGAGAAGAGCCTCTCCCACTCTCCTGGT<br>AAA | 1082 |
| SM1B220 | pDR000027921 | GAAGTGAAGCTGGTGGAAAGCGGCGGAGGCCT<br>GGTGAAACCTGGCGGCAGCCTGAAGCTGAGCT<br>GCGCCGCCAGCGGCTTCACCTTCAGCAACTAC<br>GCCATGAGCTGGGTGCGCCAGACCCCCGAGAA<br>GCGGCTGGAATGGGTGGCCAGCATCAGCAGAC<br>GGGGCAGCACCTACTACCCCGACAGCGTGAAG<br>GGCCGGTTCACCATCAGCCGGGACAACGCCCG<br>GAACATCCTGTACCTGCAGATGAGCAGCCTGC<br>GGAGCGAGGACACCGCCCTGTACTACTGCGCC<br>ACCGTGTACTACGACAACCCTTGGTTTGTGTAC<br>TGGGGCCAGGGCACCCTGGTGACAGTGTCCGC<br>TGCCAAAACGACACCACCAAGTGTCTATCCAC<br>TGGCCCCTGGATCTGCTGCCCAAACTAACTCCA<br>TGGTGACCCTGGGATGCCTGGTCAAGGGCTAT<br>TTCCCTGAGCCAGTGACAGTGACCTGGAACTCT<br>GGATCCCTGTCCAGCGGTGTGCACACCTTCCCA<br>GCTGTCCTGGAGTCTGACCTCTACACTCTGAGC<br>AGCTCAGTGACTGTCCCCTCCAGCCCTCGGCCC<br>AGCGAGACCGTCACCTGCAACGTTGCCCACCC<br>GGCCAGCAGCACCAAGGTGGACAAGAAAATTG<br>TGCCCAGGGATTGTGGTTGTAAGCCTTGCATAT<br>GTACAGTCCCAGAAGTATCATCTGTCTTCATCT<br>TCCCCCCAAAGCCCAAGGATGTGCTCACCATT | 1083 |

TABLE 38-continued

H1qA Antibody Heavy Chain CDSs

| mAB/Fab name | Construct ID | Heavy Chain CDS | SEQ ID NO: |
|---|---|---|---|
| | | ACTCTGACTCCTAAGGTCACGTGTGTTGTGGTA<br>GACATCAGCAAGGATGATCCCGAGGTCCAGTT<br>CAGCTGGTTTGTAGATGATGTGGAGGTGCACA<br>CAGCTCAGACGCAACCCCGGGAGGAGCAGTTC<br>AACAGCACTTTCCGCTCAGTCAGTGAACTTCCC<br>ATCATGCACCAGGACTGGCTCAATGGCAAGGA<br>GTTCAAATGCAGGGTCAACAGTGCAGCTTTCC<br>CTGCCCCATCGAGAAAACCATCTCCAAAACC<br>AAAGGCAGACCGAAGGCTCCACAGGTGTACAC<br>CATTCCACCTCCCAAGGAGCAGATGGCCAAGG<br>ATAAAGTCAGTCTGACCTGCATGATAACAGAC<br>TTCTTCCCTGAAGACATTACTGTGGAGTGGCAG<br>TGGAATGGGCAGCCAGCGGAGAACTACAAGA<br>ACACTCAGCCCATCATGAACACGAATGGCTCT<br>TACTTCGTCTACAGCAAGCTCAATGTGCAGAA<br>GAGCAACTGGGAGGCAGGAAATACTTTCACCT<br>GCTCTGTGTTACATGAGGGCCTGCACAACCAC<br>CATACTGAGAAGAGCCTCTCCCACTCTCCTGGT<br>AAA | |

TABLE 39

H1qA Antibody Heavy Chain Primary Transcripts

| mAB/Fab name | Construct ID | Heavy Chain Primary Transcript | SEQ ID NO: |
|---|---|---|---|
| SM1B215 | pDR000027230 | ATGGCTTGGGTGTGGACCTTGCTATTCCTGATG<br>GCAGCTGCCCAAAGTATACAGGCCGAGGTTCA<br>GCTGCAGCAGTCTGGGCCTGAGCTGAAGAAGC<br>CTGGAGAGACAGTCAAGATCTCCTGCAAGACT<br>TCTGGATATACCTTCACAATTTATGGAATGAAC<br>TGGATGAAGCAGGCTCCAGGAAAGGGTTTAAA<br>GTGGATGGGCTGGATAAACACCTACACTGGAG<br>AGCCAACATATGCTGATGACTTCAAGGGACGG<br>TTTGCCTTCTCTTTGGAAACCTCTGCCAGCACT<br>GCCTATTTGCAGATCAACAACCTCAAAAATGA<br>GGACACGGCTACATATTTCTGTGCAAGATGCT<br>ACTATAAATACGAGGACTATGCTATGGACTAC<br>TGGGGTCAAGGAACCTCAGTCACCGTCTCCTC<br>AGCCAAAACGACACCCCCATCTGTCTATCCAC<br>TGGCCCCTGGATCTGCTGCCCAAACTAACTCCA<br>TGGTGACCCTGGGATGCCTGGTCAAGGGCTAT<br>TTCCCTGAGCCAGTGACAGTGACCTGGAACTC<br>TGGATCCCTGTCCAGCGGTGTGCACACCTTCCC<br>AGCTGTCCTGGAGTCTGACCTCTACACTCTGAG<br>CAGCTCAGTGACTGTCCCCTCCAGCCCTCGGCC<br>CAGCGAGACCGTCACCTGCAACGTTGCCCACC<br>CGGCCAGCAGCACCAAGGTGGACAAGAAAATT<br>GTGCCCAGGGATTGTGGTTGTAAGCCTTGCAT<br>ATGTACAGTCCCAGAAGTATCATCTGTCTTCAT<br>CTTCCCCCCAAAGCCCAAGGATGTGCTCACCA<br>TTACTCTGACTCCTAAGGTCACGTGTGTTGTGG<br>TAGACATCAGCAAGGATGATCCCGAGGTCCAG<br>TTCAGCTGGTTTGTAGATGATGTGGAGGTGCA<br>CACAGCTCAGACGCAACCCCGGGAGGAGCAGT<br>TCAACAGCACTTTCCGCTCAGTCAGTGAACTTC<br>CCATCATGCACCAGGACTGGCTCAATGGCAAG<br>GAGTTCAAATGCAGGGTCAACAGTGCAGCTTT<br>CCCTGCCCCATCGAGAAAACCATCTCCAAAA<br>CCAAAGGCAGACCGAAGGCTCCACAGGTGTAC<br>ACCATTCCACCTCCCAAGGAGCAGATGGCCAA<br>GGATAAAGTCAGTCTGACCTGCATGATAACAG<br>ACTTCTTCCCTGAAGACATTACTGTGGAGTGGC<br>AGTGGAATGGGCAGCCAGCGGAGAACTACAA<br>GAACACTCAGCCCATCATGAACACGAATGGCT<br>CTTACTTCGTCTACAGCAAGCTCAATGTGCAGA<br>AGAGCAACTGGGAGGCAGGAAATACTTTCACC<br>TGCTCTGTGTTACATGAGGGCCTGCACAACCA<br>CCATACTGAGAAGAGCCTCTCCCACTCTCCTGG<br>TAAATGA | 1084 |

TABLE 39-continued

H1qA Antibody Heavy Chain Primary Transcripts

| mAB/Fab name | Construct ID | Heavy Chain Primary Transcript | SEQ ID NO: |
|---|---|---|---|
| SM1B216 | pDR000027231 | ATGGCTTGGGTGTGGACCTTGCTATTCCTGATG GCAGCTGCCCAAAGTATACAGGCCGAAGTGAA GCTGGTGGAGTCTGGGGGAGGTTTAGTGAAGC CTGGAGGGTCCCTGAAACTCTCCTGTGCAGCCT CTGGATTCACTTTCAGTAGCTATGCCATGTCTT GGGTTCGCCAGACTCCAGAAAAGAGGCTGGAG TGGGTCGCAGCCATTAATGGTAATGGTGGTAG CACCTACTATCCAGACACTGTGAAGGACCGAT TCACCATCTCCAGAGACAATGCCAAGAACACC CTTTACCTACAAATGAGCAGTCTGAGGTCTGA GGACACAGCCTTGTATTACTGTGCAAGACATA GGGCTGATGGTCCCTGGTTTACTTACTGGGGCC AAGGGACTCTGGTCACTGTCTCTGCAGCCAAA ACGACACCCCCATCTGTCTATCCACTGGCCCCT GGATCTGCTGCCCAAACTAACCCCATGGTGAC CCTGGGATGCCTGGTCAAGGGCTATTTCCCTGA GCCAGTGACAGTGACCTGGAACTCTGGATCCC TGTCCAGCGGTGTGCACACCTTCCCAGCTGTCC TGGAGTCTGACCTCTACACTCTGAGCAGCTCA GTGACTGTCCCCTCCAGCCCTCGGCCCAGCGA GACCGTCACCTGCAACGTTGCCCACCCGGCCA GCAGCACCAAGGTGGACAAGAAAATTGTGCCC AGGGATTGTGGTTGTAAGCCTTGCATATGTAC AGTCCCAGAAGTATCATCTGTCTTCATCTTCCC CCCAAAGCCCAAGGATGTGCTCACCATTACTC TGACTCCTAAGGTCACGTGTGTTGTGGTAGAC ATCAGCAAGGATGATCCCGAGGTCCAGTTCAG CTGGTTTGTAGATGATGTGGAGGTGCACACAG CTCAGACGCAACCCCGGGAGGAGCAGTTCAAC AGCACTTTCCGCTCAGTCAGTGAACTTCCCATC ATGCACCAGGACTGGCTCAATGGCAAGGAGTT CAAATGCAGGGTCAACAGTGCAGCTTTCCCTG CCCCCATCGAGAAAACCATCTCCAAAACCAAA GGCAGACCGAAGGCTCCACAGGTGTACACCAT TCCACCTCCCAAGGAGCAGATGGCCAAGGATA AAGTCAGTCTGACCTGCATGATAACAGACTTC TTCCCTGAAGACATTACTGTGGAGTGGCAGTG GAATGGGCAGCCAGCGGAGAACTACAAGAAC ACTCAGCCCATCATGAACACGAATGGCTCTTA CTTCGTCTACAGCAAGCTCAATGTGCAGAAGA GCAACTGGGAGGCAGGAAATACTTTCACCTGC TCTGTGTTACATGAGGGCCTGCACAACCACCA TACTGAGAAGAGCCTCTCCCACTCTCCTGGTAA ATGA | 1085 |
| SM1B217 | pDR000027921 | ATGGCTTGGGTGTGGACCTTGCTATTCCTGATG GCAGCTGCCCAAAGTATACAGGCCGAAGTGAA GCTGGTGGAAAGCGGCGGAGGCCTGGTGAAAC CTGGCGGCAGCCTGAAGCTGAGCTGCGCCGCC AGCGGCTTCACCTTCAGCAACTACGCCATGAG CTGGGTGCGCCAGACCCCCGAGAAGCGGCTGG AATGGGTGGCCAGCATCAGCAGACGGGGCAGC ACCTACTACCCCGACAGCGTGAAGGGCCGGTT CACCATCAGCCGGGACAACGCCCGGAACATCC TGTACCTGCAGATGAGCAGCCTGCGGAGCGAG GACACCGCCCTGTACTACTGCGCCACCGTGTA CTACGACAACCCTTGGTTTGTGTACTGGGGCCA GGGCACCCTGGTGACAGTGTCCGCTGCCAAAA CGACACCACCAAGTGTCTATCCACTGGCCCCT GGATCTGCTGCCCAAACTAACTCCATGGTGAC CCTGGGATGCCTGGTCAAGGGCTATTTCCCTGA GCCAGTGACAGTGACCTGGAACTCTGGATCCC TGTCCAGCGGTGTGCACACCTTCCCAGCTGTCC TGGAGTCTGACCTCTACACTCTGAGCAGCTCA GTGACTGTCCCCTCCAGCCCTCGGCCCAGCGA GACCGTCACCTGCAACGTTGCCCACCCGGCCA GCAGCACCAAGGTGGACAAGAAAATTGTGCCC AGGGATTGTGGTTGTAAGCCTTGCATATGTAC AGTCCCAGAAGTATCATCTGTCTTCATCTTCCC CCCAAAGCCCAAGGATGTGCTCACCATTACTC TGACTCCTAAGGTCACGTGTGTTGTGGTAGAC ATCAGCAAGGATGATCCCGAGGTCCAGTTCAG CTGGTTTGTAGATGATGTGGAGGTGCACACAG CTCAGACGCAACCCCGGGAGGAGCAGTTCAAC AGCACTTTCCGCTCAGTCAGTGAACTTCCCATC | 1086 |

TABLE 39-continued

H1qA Antibody Heavy Chain Primary Transcripts

| mAB/Fab name | Construct ID | Heavy Chain Primary Transcript | SEQ ID NO: |
|---|---|---|---|
| | | ATGCACCAGGACTGGCTCAATGGCAAGGAGTT CAAATGCAGGGTCAACAGTGCAGCTTTCCCTG CCCCCATCGAGAAAACCATCTCCAAAACCAAA GGCAGACCGAAGGCTCCACAGGTGTACACCAT TCCACCTCCCAAGGAGCAGATGGCCAAGGATA AAGTCAGTCTGACCTGCATGATAACAGACTTC TTCCCTGAAGACATTACTGTGGAGTGGCAGTG GAATGGGCAGCCAGCGGAGAACTACAAGAAC ACTCAGCCCATCATGAACACGAATGGCTCTTA CTTCGTCTACAGCAAGCTCAATGTGCAGAAGA GCAACTGGGAGGCAGGAAATACTTTCACCTGC TCTGTGTTACATGAGGGCCTGCACAACCACCA TACTGAGAAGAGCCTCTCCCACTCTCCTGGTAA ATGA | |
| SM1B218 | pDR000027922 | ATGGCTTGGGTGTGGACCTTGCTATTCCTGATG GCAGCTGCCCAAAGTATACAGGCCCAGATCCA GCTGGTGCAGAGCGGCCCTGAGCTGAAGAAAC CCGGCGAGACAGTGAAGATCAGCTGCAAGACC AGCGGCTACACCTTCACCATCTACGGCATGAA CTGGACCAAGCAGGCCCCTGGCAAGGGCCTGA AGTGGATGGGCTGGATCAACACCTACACCGGC GAGCCCACCTACGCCGACGACTTCAAGGGCAG ATTCGCCTTCAGCCTGGAAACCAGCGCCAGCA CCGCCTACCTGCAGATCAACAACCTGAAGAAC GAGGACACCGCCACCTACTTTTGCGCCCGGTG CTACTATAAGTACGAGGACTACGCCATGGACT ACTGGGGCCAGGGCACCAGCGTGACCGTGTCC TCTGCCAAAACGACACCACCAAGTGTCTATCC ACTGGCCCCTGGATCTGCTGCCCAAACTAACTC CATGGTGACCCTGGGATGCCTGGTCAAGGGCT ATTTCCCTGAGCCAGTGACAGTGACCTGGAAC TCTGGATCCCTGTCCAGCGGTGTGCACACCTTC CCAGCTGTCCTGGAGTCTGACCTCTACACTCTG AGCAGCTCAGTGACTGTCCCCTCCAGCCCTCG GCCCAGCGAGACCGTCACCTGCAACGTTGCCC ACCCGGCCAGCAGCACCAAGGTGGACAAGAA AATTGTGCCCAGGGATTGTGGTTGTAAGCCTTG CATATGTACAGTCCCAGAAGTATCATCTGTCTT CATCTTCCCCCCAAAGCCCAAGGATGTGCTCA CCATTACTCTGACTCCTAAGGTCACGTGTGTTG TGGTAGACATCAGCAAGGATGATCCCGAGGTC CAGTTCAGCTGGTTTGTAGATGATGTGGAGGT GCACACAGCTCAGACGCAACCCCGGGAGGAGC AGTTCAACAGCACTTTCCGCTCAGTCAGTGAA CTTCCCATCATGCACCAGGACTGGCTCAATGG CAAGGAGTTCAAATGCAGGGTCAACAGTGCAG CTTTCCCTGCCCCCATCGAGAAAACCATCTCCA AAACCAAAGGCAGACCGAAGGCTCCACAGGT GTACACCATTCCACCTCCCAAGGAGCAGATGG CCAAGGATAAAGTCAGTCTGACCTGCATGATA ACAGACTTCTTCCCTGAAGACATTACTGTGGA GTGGCAGTGGAATGGGCAGCCAGCGGAGAACT ACAAGAACACTCAGCCCATCATGAACACGAAT GGCTCTTACTTCGTCTACAGCAAGCTCAATGTG CAGAAGAGCAACTGGGAGGCAGGAAATACTTT CACCTGCTCTGTGTTACATGAGGGCCTGCACA ACCACCATACTGAGAAGAGCCTCTCCCACTCT CCTGGTAAATGA | 1087 |
| SM1B219 | pDR000027923 | ATGGCTTGGGTGTGGACCTTGCTATTCCTGATG GCAGCTGCCCAAAGTATACAGGCCGACGTGAA GCTGGTGGAAAGCGGCGGAGGCCTGGTGAAAC CTGGCGGCAGCCTGAAGCTGAGCTGCGCCGCC AGCGGCTTCACCTTCAGCAGCTACGCCATGAG CTGGGTGCGCCAGACCCCCGAGAAGCGGCTGG AATGGGTGGCCGCCATCAACGGCAACGGCGGC AGCACCTACTACCCCGACACCGTGAAGGACCG GTTCACCATCAGCCGGGACAACGCCAAGAACA CCCTGTACCTGCAGATGAGCAGCCTGCGGAGC GAGGACACCGCCCTGTACTACTGCGCCAGACA CAGAGCCGACGGCCCCTGGTTCACATACTGGG GCCAGGGCACCCTGGTGACAGTGTCCGCTGCC AAAACGACACCACCAAGTGTCTATCCACTGGC CCCTGGATCTGCTGCCCAAACTAACTCCATGGT |  1088 |

TABLE 39-continued

H1qA Antibody Heavy Chain Primary Transcripts

| mAB/Fab name | Construct ID | Heavy Chain Primary Transcript | SEQ ID NO: |
|---|---|---|---|
| | | GACCCTGGGATGCCTGGTCAAGGGCTATTTCC<br>CTGAGCCAGTGACAGTGACCTGGAACTCTGGA<br>TCCCTGTCCAGCGGTGTGCACACCTTCCCAGCT<br>GTCCTGGAGTCTGACCTCTACACTCTGAGCAGC<br>TCAGTGACTGTCCCCTCCAGCCCTCGGCCCAGC<br>GAGACCGTCACCTGCAACGTTGCCCACCCGGC<br>CAGCAGCACCAAGGTGGACAAGAAAATTGTGC<br>CCAGGGATTGTGGTTGTAAGCCTTGCATATGTA<br>CAGTCCCAGAAGTATCATCTGTCTTCATCTTCC<br>CCCCAAAGCCCAAGGATGTGCTCACCATTACT<br>CTGACTCCTAAGGTCACGTGTGTTGTGGTAGAC<br>ATCAGCAAGGATGATCCCGAGGTCCAGTTCAG<br>CTGGTTTGTAGATGATGTGGAGGTGCACACAG<br>CTCAGACGCAACCCCGGGAGGAGCAGTTCAAC<br>AGCACTTTCCGCTCAGTCAGTGAACTTCCCATC<br>ATGCACCAGGACTGGCTCAATGGCAAGGAGTT<br>CAAATGCAGGGTCAACAGTGCAGCTTTCCCTG<br>CCCCCATCGAGAAAACCATCTCCAAAACCAAA<br>GGCAGACCGAAGGCTCCACAGGTGTACACCAT<br>TCCACCTCCCAAGGAGCAGATGGCCAAGGATA<br>AAGTCAGTCTGACCTGCATGATAACAGACTTC<br>TTCCCTGAAGACATTACTGTGGAGTGGCAGTG<br>GAATGGGCAGCCAGCGGAGAACTACAAGAAC<br>ACTCAGCCCATCATGAACACGAATGGCTCTTA<br>CTTCGTCTACAGCAAGCTCAATGTGCAGAAGA<br>GCAACTGGGAGGCAGGAAATACTTTCACCTGC<br>TCTGTGTTACATGAGGGCCTGCACAACCACCA<br>TACTGAGAAGAGCCTCTCCCACTCTCCTGGTAA<br>ATGA | |
| SM1B220 | pDR000027921 | ATGGCTTGGGTGTGGACCTTGCTATTCCTGATG<br>GCAGCTGCCCAAAGTATACAGGCCGAAGTGAA<br>GCTGGTGGAAAGCGGCGGAGGCCTGGTGAAAC<br>CTGGCGGCAGCCTGAAGCTGAGCTGCGCCGCC<br>AGCGGCTTCACCTTCAGCAACTACGCCATGAG<br>CTGGGTGCGCCAGACCCCCGAGAAGCGGCTGG<br>AATGGGTGGCCAGCATCAGCAGACGGGGCAGC<br>ACCTACTACCCCGACAGCGTGAAGGGCCGGTT<br>CACCATCAGCCGGGACAACGCCCGGAACATCC<br>TGTACCTGCAGATGAGCAGCCTGCGGAGCGAG<br>GACACCGCCCTGTACTACTGCGCCACCGTGTA<br>CTACGACAACCCTTGGTTTGTGTACTGGGGCCA<br>GGGCACCCTGGTGACAGTGTCCGCTGCCAAAA<br>CGACACCACCAAGTGTCTATCCACTGGCCCCT<br>GGATCTGCTGCCCAAACTAACTCCATGGTGAC<br>CCTGGGATGCCTGGTCAAGGGCTATTTCCCTGA<br>GCCAGTGACAGTGACCTGGAACTCTGGATCCC<br>TGTCCAGCGGTGTGCACACCTTCCCAGCTGTCC<br>TGGAGTCTGACCTCTACACTCTGAGCAGCTCA<br>GTGACTGTCCCCTCCAGCCCTCGGCCCAGCGA<br>GACCGTCACCTGCAACGTTGCCCACCCGGCCA<br>GCAGCACCAAGGTGGACAAGAAAATTGTGCCC<br>AGGGATTGTGGTTGTAAGCCTTGCATATGTAC<br>AGTCCCAGAAGTATCATCTGTCTTCATCTTCCC<br>CCCAAAGCCCAAGGATGTGCTCACCATTACTC<br>TGACTCCTAAGGTCACGTGTGTTGTGGTAGAC<br>ATCAGCAAGGATGATCCCGAGGTCCAGTTCAG<br>CTGGTTTGTAGATGATGTGGAGGTGCACACAG<br>CTCAGACGCAACCCCGGGAGGAGCAGTTCAAC<br>AGCACTTTCCGCTCAGTCAGTGAACTTCCCATC<br>ATGCACCAGGACTGGCTCAATGGCAAGGAGTT<br>CAAATGCAGGGTCAACAGTGCAGCTTTCCCTG<br>CCCCCATCGAGAAAACCATCTCCAAAACCAAA<br>GGCAGACCGAAGGCTCCACAGGTGTACACCAT<br>TCCACCTCCCAAGGAGCAGATGGCCAAGGATA<br>AAGTCAGTCTGACCTGCATGATAACAGACTTC<br>TTCCCTGAAGACATTACTGTGGAGTGGCAGTG<br>GAATGGGCAGCCAGCGGAGAACTACAAGAAC<br>ACTCAGCCCATCATGAACACGAATGGCTCTTA<br>CTTCGTCTACAGCAAGCTCAATGTGCAGAAGA<br>GCAACTGGGAGGCAGGAAATACTTTCACCTGC<br>TCTGTGTTACATGAGGGCCTGCACAACCACCA<br>TACTGAGAAGAGCCTCTCCCACTCTCCTGGTAA<br>ATGA | 1089 |

TABLE 40

HlqA Antibody Light Chain CDSs

| mAB/Fab name | Construct ID | Light_Chain.CDS | SEQ ID NO: |
|---|---|---|---|
| SM1B215 | pDR000027233 | GATGTTGTGATGACCCAAACTCCACTCACTTTG TCGGTTACCATTGGACAACCCGCCTCCATCTCT TGCAAGTCAAGTCAGAGCCTCTTAGATAGTGA TGGAAAGACATATTTGAATTGGTTGTTACAGA GGCCAGGCCAGTCTCCGAAGCGCCTAATCTAT GTGGTGTCTAAATTGGACTCTGGAGTCCCTGAC AGGTTCACTGGCAGTGGATCAGGGACAGATTT CACACTGAAAATCAGCAGAGTGGAGGCTGAGG ATTTGGGAGTTTATTATTGCTGGCAAGGTACAC ATTTTCCGCTCACGTTCGGTGCTGGGACCAAGC TGGAGCTGAAACGGGCTGATGCTGCACCAACT GTATCCATCTTCCCACCATCCAGTGAGCAGTTA ACATCTGGAGGTGCCTCAGTCGTGTGCTTCTTG AACAACTTCTACCCCAAAGACATCAATGTCAA GTGGAAGATTGATGGCAGTGAACGACAAAATG GCGTCCTGAACAGTTGGACTGATCAGGACAGC AAAGACAGCACCTACAGCATGAGCAGCACCCT CACGTTGACCAAGGACGAGTATGAACGACATA ACAGCTATACCTGTGAGGCCACTCACAAGACA TCAACTTCACCCATTGTCAAGAGCTTCAACAG GAATGAGTGT | 1090 |
| SM1B216 | pDR000027232 | GATGTTGTGATGACCCAAACTCCATCCTCCTTT TCTGTATCTCTAGGAGACGGAGTCACCATTACT TGCAAGGCAAGTGAGGACATATATATTCGGTT AGCCTGGTATCAGCAGAAACCAGGAAATGCTC CTAGGCTCCTAATATTTGGTGCAACCAGTTTGG AAACTGGGGTTCCTTCAAGATTCAGTGGCAGT GGATCTGGAAAGGATTACACTCTCAGCATTAC CAGTCTTCAGACTGAAGATGTTGCTACTTATTA CTGTCAACAGTATTGGAGAACTCCGCTCACGTT CGGTGCTGGGACCAAGCTGGAGCTGAAACGGG CTGATGCTGCACCAACTGTATCCATCTTCCCAC CATCCAGTGAGCAGTTAACATCTGGAGGTGCC TCAGTCGTGTGCTTCTTGAACAACTTCTACCCC AAAGACATCAATGTCAAGTGGAAGATTGATGG CAGTGAACGACAAAATGGCGTCCTGAACAGTT GGACTGATCAGGACAGCAAAGACAGCACCTAC AGCATGAGCAGCACCCTCACGTTGACCAAGGA CGAGTATGAACGACATAACAGCTATACCTGTG AGGCCACTCACAAGACATCAACTTCACCCATT GTCAAGAGCTTCAACAGGAATGAGTGT | 1091 |
| SM1B217 | pDR000027924 | GACGTGGTGATGACCCAGACCCCCCTGACCCT GAGCGTGACCATCGGCCAGCCTGCCAGCATCA GCTGCAAGAGCAGCCAGAGCCTGCTGGACAGC GACGGCAAGACCTACCTGAACTGGCTGCTGCA GCGGCCTGGCCAGAGCCCCAAGCGGCTGATCT ACCTGGTGTCCAAGCTGGACTCCGGCGTGCCC GACAGATTCACAGGCAGCGGCAGCGGCACCGA CTTCACCCTGAAGATCAGCCGGGTGGAAGCCG AGGACCTGGGCGTGTACTACTGCTGGCAGGGC ACCCACTTCCCACTGACCTTCGGAGCCGGCAC CAAGCTGGAACTGAAGCGGGCTGATGCTGCAC CGACTGTGTCCATCTTCCCACCATCCAGTGAGC AGTTAACATCTGGAGGTGCCTCAGTCGTGTGCT TCTTGAACAACTTCTACCCCAAAGACATCAAT GTCAAGTGGAAGATTGATGGCAGTGAACGACA AAATGGCGTCCTGAACAGTTGGACTGATCAGG ACAGCAAAGACAGCACCTACAGCATGAGCAGC ACCCTCACGTTGACCAAGGACGAGTATGAACG ACATAACAGCTATACCTGTGAGGCCACTCACA AGACATCAACTTCACCCATTGTCAAGAGCTTC AACAGGAATGAGTGT | 1092 |
| SM1B218 | pDR000027924 | GACGTGGTGATGACCCAGACCCCCCTGACCCT GAGCGTGACCATCGGCCAGCCTGCCAGCATCA GCTGCAAGAGCAGCCAGAGCCTGCTGGACAGC GACGGCAAGACCTACCTGAACTGGCTGCTGCA GCGGCCTGGCCAGAGCCCCAAGCGGCTGATCT ACCTGGTGTCCAAGCTGGACTCCGGCGTGCCC GACAGATTCACAGGCAGCGGCAGCGGCACCGA CTTCACCCTGAAGATCAGCCGGGTGGAAGCCG AGGACCTGGGCGTGTACTACTGCTGGCAGGGC ACCCACTTCCCACTGACCTTCGGAGCCGGCAC | 1093 |

TABLE 40-continued

HlgA Antibody Light Chain CDSs

| mAB/Fab name | Construct ID | Light_Chain.CDS | SEQ ID NO: |
|---|---|---|---|
| | | CAAGCTGGAACTGAAGCGGGCTGATGCTGCAC CGACTGTGTCCATCTTCCCACCATCCAGTGAGC AGTTAACATCTGGAGGTGCCTCAGTCGTGTGCT TCTTGAACAACTTCTACCCCAAAGACATCAAT GTCAAGTGGAAGATTGATGGCAGTGAACGACA AAATGGCGTCCTGAACAGTTGGACTGATCAGG ACAGCAAAGACAGCACCTACAGCATGAGCAGC ACCCTCACGTTGACCAAGGACGAGTATGAACG ACATAACAGCTATACCTGTGAGGCCACTCACA AGACATCAACTTCACCCATTGTCAAGAGCTTC AACAGGAATGAGTGT | |
| SM1B219 | pDR000027233 | GATGTTGTGATGACCCAAACTCCACTCACTTTG TCGGTTACCATTGGACAACCCGCCTCCATCTCT TGCAAGTCAAGTCAGAGCCTCTTAGATAGTGA TGGAAAGACATATTTGAATTGGTTGTTACAGA GGCCAGGCCAGTCTCCGAAGCGCCTAATCTAT GTGGTGTCTAAATTGGACTCTGGAGTCCCTGAC AGGTTCACTGGCAGTGGATCAGGGACAGATTT CACACTGAAAATCAGCAGAGTGGAGGCTGAGG ATTTGGGAGTTTATTATTGCTGGCAAGGTACAC ATTTTCCGCTCACGTTCGGTGCTGGGACCAAGC TGGAGCTGAAACGGGCTGATGCTGCACCAACT GTATCCATCTTCCCACCATCCAGTGAGCAGTTA ACATCTGGAGGTGCCTCAGTCGTGTGCTTCTTG AACAACTTCTACCCCAAAGACATCAATGTCAA GTGGAAGATTGATGGCAGTGAACGACAAAATG GCGTCCTGAACAGTTGGACTGATCAGGACAGC AAAGACAGCACCTACAGCATGAGCAGCACCCT CACGTTGACCAAGGACGAGTATGAACGACATA ACAGCTATACCTGTGAGGCCACTCACAAGACA TCAACTTCACCCATTGTCAAGAGCTTCAACAG GAATGAGTGT | 1094 |
| SM1B220 | pDR000027233 | GATGTTGTGATGACCCAAACTCCACTCACTTTG TCGGTTACCATTGGACAACCCGCCTCCATCTCT TGCAAGTCAAGTCAGAGCCTCTTAGATAGTGA TGGAAAGACATATTTGAATTGGTTGTTACAGA GGCCAGGCCAGTCTCCGAAGCGCCTAATCTAT GTGGTGTCTAAATTGGACTCTGGAGTCCCTGAC AGGTTCACTGGCAGTGGATCAGGGACAGATTT CACACTGAAAATCAGCAGAGTGGAGGCTGAGG ATTTGGGAGTTTATTATTGCTGGCAAGGTACAC ATTTTCCGCTCACGTTCGGTGCTGGGACCAAGC TGGAGCTGAAACGGGCTGATGCTGCACCAACT GTATCCATCTTCCCACCATCCAGTGAGCAGTTA ACATCTGGAGGTGCCTCAGTCGTGTGCTTCTTG AACAACTTCTACCCCAAAGACATCAATGTCAA GTGGAAGATTGATGGCAGTGAACGACAAAATG GCGTCCTGAACAGTTGGACTGATCAGGACAGC AAAGACAGCACCTACAGCATGAGCAGCACCCT CACGTTGACCAAGGACGAGTATGAACGACATA ACAGCTATACCTGTGAGGCCACTCACAAGACA TCAACTTCACCCATTGTCAAGAGCTTCAACAG GAATGAGTGT | 1095 |

TABLE 41

HlgA Antibody Light Chain Primary Transcripts

| mAB/Fab name | Construct ID | Light Chain Primary Transcript | SEQ ID NO: |
|---|---|---|---|
| SM1B215 | pDR000027233 | ATGGAGACACATTCTCAGGTCTTTGTATACATG TTGCTGTGGTTGTCTGGTGTCGAGGGCGATGTT GTGATGACCCAAACTCCACTCACTTTGTCGGTT ACCATTGGACAACCCGCCTCCATCTCTTGCAAG TCAAGTCAGAGCCTCTTAGATAGTGATGGAAA GACATATTTGAATTGGTTGTTACAGAGGCCAG GCCAGTCTCCGAAGCGCCTAATCTATGTGGTGT CTAAATTGGACTCTGGAGTCCCTGACAGGTTC ACTGGCAGTGGATCAGGGACAGATTTCACACT | 1096 |

TABLE 41-continued

HlgA Antibody Light Chain Primary Transcripts

| mAB/Fab name | Construct ID | Light Chain Primary Transcript | SEQ ID NO: |
|---|---|---|---|
| | | GAAAATCAGCAGAGTGGAGGCTGAGGATTTGG GAGTTTATTATTGCTGGCAAGGTACACATTTTC CGCTCACGTTCGGTGCTGGGACCAAGCTGGAG CTGAAACGGGCTGATGCTGCACCAACTGTATC CATCTTCCCACCATCCAGTGAGCAGTTAACATC TGGAGGTGCCTCAGTCGTGTGCTTCTTGAACAA CTTCTACCCCAAAGACATCAATGTCAAGTGGA AGATTGATGGCAGTGAACGACAAAATGGCGTC CTGAACAGTTGGACTGATCAGGACAGCAAAGA CAGCACCTACAGCATGAGCAGCACCCTCACGT TGACCAAGGACGAGTATGAACGACATAACAGC TATACCTGTGAGGCCACTCACAAGACATCAAC TTCACCCATTGTCAAGAGCTTCAACAGGAATG AGTGTTAG | |
| SM1B216 | pDR000027232 | ATGGAGACACATTCTCAGGTCTTTGTATACATG TTGCTGTGGTTGTCTGGTGTCGAGGGCGATGTT GTGATGACCCAAACTCCATCCTCCTTTTCTGTA TCTCTAGGAGACGGAGTCACCATTACTTGCAA GGCAAGTGAGGACATATATATTCGGTTAGCCT GGTATCAGCAGAAACCAGGAAATGCTCCTAGG CTCCTAATATTTGGTGCAACCAGTTTGGAAACT GGGGGTTCCTTCAAGATTCAGTGGCAGTGGATC TGGAAAGGATTACACTCTCAGCATTACCAGTC TTCAGACTGAAGATGTTGCTACTTATTACTGTC AACAGTATTGGAGAACTCCGCTCACGTTCGGT GCTGGGACCAAGCTGGAGCTGAAACGGGCTGA TGCTGCACCAACTGTATCCATCTTCCCACCATC CAGTGAGCAGTTAACATCTGGAGGTGCCTCAG TCGTGTGCTTCTTGAACAACTTCTACCCCAAAG ACATCAATGTCAAGTGGAAGATTGATGGCAGT GAACGACAAAATGGCGTCCTGAACAGTTGGAC TGATCAGGACAGCAAAGACAGCACCTACAGCA TGAGCAGCACCCTCACGTTGACCAAGGACGAG TATGAACGACATAACAGCTATACCTGTGAGGC CACTCACAAGACATCAACTTCACCCATTGTCA AGAGCTTCAACAGGAATGAGTGTTAG | 1097 |
| SM1B217 | pDR000027924 | ATGGAGACACATTCTCAGGTCTTTGTATACATG TTGCTGTGGTTGTCTGGTGTCGAGGGCGACGTG GTGATGACCCAGACCCCCCTGACCCTGAGCGT GACCATCGGCCAGCCTGCCAGCATCAGCTGCA AGAGCAGCCAGAGCCTGCTGGACAGCGACGGC AAGACCTACCTGAACTGGCTGCTGCAGCGGCC TGGCCAGAGCCCCAAGCGGCTGATCTACCTGG TGTCCAAGCTGGACTCCGGCGTGCCCGACAGA TTCACAGGCAGCGGCAGCGGCACCGACTTCAC CCTGAAGATCAGCCGGGTGGAAGCCGAGGACC TGGGCGTGTACTACTGCTGGCAGGGCACCCAC TTCCCACTGACCTTCGGAGCCGGCACCAAGCT GGAACTGAAGCGGGCTGATGCTGCACCGACTG TGTCCATCTTCCCACCATCCAGTGAGCAGTTAA CATCTGGAGGTGCCTCAGTCGTGTGCTTCTTGA ACAACTTCTACCCCAAAGACATCAATGTCAAG TGGAAGATTGATGGCAGTGAACGACAAAATGG CGTCCTGAACAGTTGGACTGATCAGGACAGCA AAGACAGCACCTACAGCATGAGCAGCACCCTC ACGTTGACCAAGGACGAGTATGAACGACATAA CAGCTATACCTGTGAGGCCACTCACAAGACAT CAACTTCACCCATTGTCAAGAGCTTCAACAGG AATGAGTGTTAG | 1098 |
| SM1B218 | pDR000027924 | ATGGAGACACATTCTCAGGTCTTTGTATACATG TTGCTGTGGTTGTCTGGTGTCGAGGGCGACGTG GTGATGACCCAGACCCCCCTGACCCTGAGCGT GACCATCGGCCAGCCTGCCAGCATCAGCTGCA AGAGCAGCCAGAGCCTGCTGGACAGCGACGGC AAGACCTACCTGAACTGGCTGCTGCAGCGGCC TGGCCAGAGCCCCAAGCGGCTGATCTACCTGG TGTCCAAGCTGGACTCCGGCGTGCCCGACAGA TTCACAGGCAGCGGCAGCGGCACCGACTTCAC CCTGAAGATCAGCCGGGTGGAAGCCGAGGACC TGGGCGTGTACTACTGCTGGCAGGGCACCCAC TTCCCACTGACCTTCGGAGCCGGCACCAAGCT GGAACTGAAGCGGGCTGATGCTGCACCGACTG | 1099 |

TABLE 41-continued

HlgA Antibody Light Chain Primary Transcripts

| mAB/Fab name | Construct ID | Light Chain Primary Transcript | SEQ ID NO: |
|---|---|---|---|
| | | TGTCCATCTTCCCACCATCCAGTGAGCAGTTAA CATCTGGAGGTGCCTCAGTCGTGTGCTTCTTGA ACAACTTCTACCCCAAAGACATCAATGTCAAG TGGAAGATTGATGGCAGTGAACGACAAAATGG CGTCCTGAACAGTTGGACTGATCAGGACAGCA AAGACAGCACCTACAGCATGAGCAGCACCCTC ACGTTGACCAAGGACGAGTATGAACGACATAA CAGCTATACCTGTGAGGCCACTCACAAGACAT CAACTTCACCCATTGTCAAGAGCTTCAACAGG AATGAGTGTTAG | |
| SM1B219 | pDR000027233 | ATGGAGACACATTCTCAGGTCTTTGTATACATG TTGCTGTGGTTGTCTGGTGTCGAGGGCGATGTT GTGATGACCCAAACTCCACTCACTTTGTCGGTT ACCATTGGACAACCCGCCTCCATCTCTTGCAAG TCAAGTCAGAGCCTCTTAGATAGTGATGGAAA GACATATTTGAATTGGTTGTTACAGAGGCCAG GCCAGTCTCCGAAGCGCCTAATCTATGTGGTGT CTAAATTGGACTCTGGAGTCCCTGACAGGTTC ACTGGCAGTGGATCAGGGACAGATTTCACACT GAAAATCAGCAGAGTGGAGGCTGAGGATTTGG GAGTTTATTATTGCTGGCAAGGTACACATTTTC CGCTCACGTTCGGTGCTGGGACCAAGCTGGAG CTGAAACGGGCTGATGCTGCACCAACTGTATC CATCTTCCCACCATCCAGTGAGCAGTTAACATC TGGAGGTGCCTCAGTCGTGTGCTTCTTGAACAA CTTCTACCCCAAAGACATCAATGTCAAGTGGA AGATTGATGGCAGTGAACGACAAAATGGCGTC CTGAACAGTTGGACTGATCAGGACAGCAAAGA CAGCACCTACAGCATGAGCAGCACCCTCACGT TGACCAAGGACGAGTATGAACGACATAACAGC TATACCTGTGAGGCCACTCACAAGACATCAAC TTCACCCATTGTCAAGAGCTTCAACAGGAATG AGTGTTAG | 1100 |
| SM1B220 | pDR000027233 | ATGGAGACACATTCTCAGGTCTTTGTATACATG TTGCTGTGGTTGTCTGGTGTCGAGGGCGATGTT GTGATGACCCAAACTCCACTCACTTTGTCGGTT ACCATTGGACAACCCGCCTCCATCTCTTGCAAG TCAAGTCAGAGCCTCTTAGATAGTGATGGAAA GACATATTTGAATTGGTTGTTACAGAGGCCAG GCCAGTCTCCGAAGCGCCTAATCTATGTGGTGT CTAAATTGGACTCTGGAGTCCCTGACAGGTTC ACTGGCAGTGGATCAGGGACAGATTTCACACT GAAAATCAGCAGAGTGGAGGCTGAGGATTTGG GAGTTTATTATTGCTGGCAAGGTACACATTTTC CGCTCACGTTCGGTGCTGGGACCAAGCTGGAG CTGAAACGGGCTGATGCTGCACCAACTGTATC CATCTTCCCACCATCCAGTGAGCAGTTAACATC TGGAGGTGCCTCAGTCGTGTGCTTCTTGAACAA CTTCTACCCCAAAGACATCAATGTCAAGTGGA AGATTGATGGCAGTGAACGACAAAATGGCGTC CTGAACAGTTGGACTGATCAGGACAGCAAAGA CAGCACCTACAGCATGAGCAGCACCCTCACGT TGACCAAGGACGAGTATGAACGACATAACAGC TATACCTGTGAGGCCACTCACAAGACATCAAC TTCACCCATTGTCAAGAGCTTCAACAGGAATG AGTGTTAG | 1101 |

TABLE 42

HlgC Antibody Heavy Chain CDSs

| mAB/Fab name | Construct ID | Heavy Chain CDS | SEQ ID NO: |
|---|---|---|---|
| SM1B202 | pDR000027136 | GAAGTGATGCTGGTGGAAAGCGGCGGAGGCCT GGTGAAACCTGGCGGCAGCCTGAAGCTGAGCT GCGCCGCCAGCGGCTTCACCTTCAGCAACTAC GCCATGAGCTGGGTCCGCCAGACCCCCGAGAA GCGGCTGGAATGGGTGGCCAGCATCAGCAGAC GGGGCAGCACCTACTACCCCGACAGCGGCAAG | 1102 |

TABLE 42-continued

HlqC Antibody Heavy Chain CDSs

| mAB/Fab name | Construct ID | Heavy Chain CDS | SEQ ID NO: |
|---|---|---|---|
| | | GGCCGGTTCACCATCAGCCGGGACAACGCCCG<br>GAACATCCCCTACCTGCAGATGAGCAGCCTGC<br>GGAGCGAGGACACCGCCCTGTACTACTGCGCC<br>ACCGTGTACTACGACAACCCTTGGTTTGTGTAC<br>TGGGGCCAGGGCACCCTGGTGACAGTGTCCGC<br>TGCCAAAACAACAGCACCAAGTGTCTATCCAC<br>TGGCCCCTGTGTGTGGAGATACAACTGGCTCCT<br>CGGTGACTCTAGGATGCCTGGTCAAGGGTTATT<br>TCCCTGAGCCAGTGACCTTGACCTGGAACTCTG<br>GATCCCTGTCCAGTGGTGTGCACACCTTCCCAG<br>CTGTCCTGCAGTCTGACCTCTACACCCTCAGCA<br>GCTCAGTGACTGTAACCTCGAGCACCTGGCCC<br>AGCCAGTCCATCACCTGCAATGTGGCCCACCC<br>GGCAAGCAGCACCAAGGTGGACAAGAAAATT<br>GAGCCCAGAGGGCCCACAATCAAGCCCTGTCC<br>TCCATGCAAATGCCCAGCACCTAACCTCTTGGG<br>TGGACCATCCGTCTTCATCTTCCCTCCAAAGAT<br>CAAGGATGTACTCATGATCTCCCTGAGCCCCAT<br>AGTCACATGTGTGGTGGTGGATGTGAGCGAGG<br>ATGACCCAGATGTCCAGATCAGCTGGTTTGTG<br>AACAACGTGGAAGTACACACAGCTCAGACACA<br>AACCCATAGAGAGGATTACAACAGTACTCTCC<br>GGGTGGTCAGTGCCCTCCCCATCCAGCACCAG<br>GACTGGATGAGTGGCAAGGAGTTCAAATGCAA<br>GGTCAACAACAAAGACCTCCCAGCGCCCATCG<br>AGAGAACCATCTCAAAACCCAAAGGGTCAGTA<br>AGAGCTCCACAGGTATATGTCTTGCCTCCACCA<br>GAAGAAGAGATGACTAAGAAACAGGTCACTCT<br>GACCTGCATGGTCACAGACTTCATGCCTGAAG<br>ACATTTACGTGGAGTGGACCAACAACGGGAAA<br>ACAGAGCTAAACTACAAGAACACTGAACCAGT<br>CCTGGACTCTGATGGTTCTTACTTCATGTACAG<br>CAAGCTGAGAGTGGAAAAGAAGAACTGGGTG<br>GAAAGAAATAGCTACTCCTGTTCAGTGGTCCA<br>CGAGGGTCTGCACAATCACCACACGACTAAGA<br>GCTTCTCCCGGACTCCGGGTAAA | |
| SM1B203 | pDR000027135 | GAAGTGATGCTGGTGGAAAGCGGCGGAGGCCT<br>GGTGAAACCTGGCGGCAGCCTGAAGCTGAGCT<br>GCGCCGCCAGCGGCTTCACCTTCAGCAACTAC<br>GCCATGAGCTGGGTCCGCCAGACCCCCGAGAA<br>GCGGCTGGAATGGGTGGCCAGCATCAGCAGAC<br>GGGGCAGCACCTACTACCCCGACAGCGTGAAG<br>GGCCGGTTCACCATCAGCCGGGACAACGCCCG<br>GAACATCCTGTACCTGCAGATGAGCAGCCTGC<br>GGAGCGAGGACACCGCCCTGTACTACTGCGCC<br>ACCGTGTACTACGACAACCCTTGGTTTGTGTAC<br>TGGGGCCAGGGCACCCTGGTGACAGTGTCCGC<br>TGCCAAAACAACAGCACCAAGTGTCTATCCAC<br>TGGCCCCTGTGTGTGGAGATACAACTGGCTCCT<br>CGGTGACTCTAGGATGCCTGGTCAAGGGTTATT<br>TCCCTGAGCCAGTGACCTTGACCTGGAACTCTG<br>GATCCCTGTCCAGTGGTGTGCACACCTTCCCAG<br>CTGTCCTGCAGTCTGACCTCTACACCCTCAGCA<br>GCTCAGTGACTGTAACCTCGAGCACCTGGCCC<br>AGCCAGTCCATCACCTGCAATGTGGCCCACCC<br>GGCAAGCAGCACCAAGGTGGACAAGAAAATT<br>GAGCCCAGAGGGCCCACAATCAAGCCCTGTCC<br>TCCATGCAAATGCCCAGCACCTAACCTCTTGGG<br>TGGACCATCCGTCTTCATCTTCCCTCCAAAGAT<br>CAAGGATGTACTCATGATCTCCCTGAGCCCCAT<br>AGTCACATGTGTGGTGGTGGATGTGAGCGAGG<br>ATGACCCAGATGTCCAGATCAGCTGGTTTGTG<br>AACAACGTGGAAGTACACACAGCTCAGACACA<br>AACCCATAGAGAGGATTACAACAGTACTCTCC<br>GGGTGGTCAGTGCCCTCCCCATCCAGCACCAG<br>GACTGGATGAGTGGCAAGGAGTTCAAATGCAA<br>GGTCAACAACAAAGACCTCCCAGCGCCCATCG<br>AGAGAACCATCTCAAAACCCAAAGGGTCAGTA<br>AGAGCTCCACAGGTATATGTCTTGCCTCCACCA<br>GAAGAAGAGATGACTAAGAAACAGGTCACTCT<br>GACCTGCATGGTCACAGACTTCATGCCTGAAG<br>ACATTTACGTGGAGTGGACCAACAACGGGAAA<br>ACAGAGCTAAACTACAAGAACACTGAACCAGT<br>CCTGGACTCTGATGGTTCTTACTTCATGTACAG | 1103 |

TABLE 42-continued

H1qC Antibody Heavy Chain CDSs

| mAB/Fab name | Construct ID | Heavy Chain CDS | SEQ ID NO: |
|---|---|---|---|
| | | CAAGCTGAGAGTGGAAAAGAAGAACTGGGTG GAAAGAAATAGCTACTCCTGTTCAGTGGTCCA CGAGGGTCTGCACAATCACCACACGACTAAGA GCTTCTCCCGGACTCCGGGTAAA | |
| SM1B204 | pDR000027134 | GAAGTGAAGCTGGTGGAAAGCGGCGGAGGCCT GGTGAAACCTGGCGGCAGCCTGAAGCTGAGCT GCGCCGCCAGCGGCTTCACCTTCAGCAACTAC GCCATGAGCTGGGTCCGCCAGACCCCCGAGAA GCGGCTGGAATGGGTGGCCAGCATCAGCAGAC GGGGCAGCACCTACTACCCCGACAGCGTGAAG GGCCGGTTCACCATCAGCGGGACAACGCCCG GAACATCCTGTACCTGCAGATGAGCAGCCTGC GGAGCGAGGACACCGCCCTGTACTACTGCGCC ACCGTGTACTACGACAACCCTTGGTTTGTGTAC TGGGGCCAGGGCACCCTGGTGACAGTGTCCGC TGCCAAAACAACAGCACCAAGTGTCTATCCAC TGGCCCCTGTGTGTGGAGATACAACTGGCTCCT CGGTGACTCTAGGATGCCTGGTCAAGGGTTATT TCCCTGAGCCAGTGACCTTGACCTGGAACTCTG GATCCCTGTCCAGTGGTGTGCACACCTTCCCAG CTGTCCTGCAGTCTGACCTCTACACCCTCAGCA GCTCAGTGACTGTAACCTCGAGCACCTGGCCC AGCCAGTCCATCACCTGCAATGTGGCCCACCC GGCAAGCAGCACCAAGGTGGACAAGAAAATT GAGCCCAGAGGGCCCACAATCAAGCCCTGTCC TCCATGCAAATGCCCAGCACCTAACCTCTTGGG TGGACCATCCGTCTTCATCTTCCCTCCAAAGAT CAAGGATGTACTCATGATCTCCCTGAGCCCCAT AGTCACATGTGTGGTGGTGGATGTGAGCGAGG ATGACCCAGATGTCCAGATCAGCTGGTTTGTG AACAACGTGGAAGTACACACAGCTCAGACACA AACCCATAGAGAGGATTACAACAGTACTCTCC GGGTGGTCAGTGCCCTCCCCATCCAGCACCAG GACTGGATGAGTGGCAAGGAGTTCAAATGCAA GGTCAACAACAAAGACCTCCCAGCGCCCATCG AGAGAACCATCTCAAAACCCAAAGGGTCAGTA AGAGCTCCACAGGTATATGTCTTGCCTCCACCA GAAGAAGAGATGACTAAGAAACAGGTCACTCT GACCTGCATGGTCACAGACTTCATGCCTGAAG ACATTTACGTGGAGTGGACCAACAACGGGAAA ACAGAGCTAAACTACAAGAACACTGAACCAGT CCTGGACTCTGATGGTTCTTACTTCATGTACAG CAAGCTGAGAGTGGAAAAGAAGAACTGGGTG GAAAGAAATAGCTACTCCTGTTCAGTGGTCCA CGAGGGTCTGCACAATCACCACACGACTAAGA GCTTCTCCCGGACTCCGGGTAAA | 1104 |
| SM1B205 | pDR000027134 | GAAGTGAAGCTGGTGGAAAGCGGCGGAGGCCT GGTGAAACCTGGCGGCAGCCTGAAGCTGAGCT GCGCCGCCAGCGCTTCACCTTCAGCAACTAC GCCATGAGCTGGGTCCGCCAGACCCCCGAGAA GCGGCTGGAATGGGTGGCCAGCATCAGCAGAC GGGGCAGCACCTACTACCCCGACAGCGTGAAG GGCCGGTTCACCATCAGCGGGACAACGCCCG GAACATCCTGTACCTGCAGATGAGCAGCCTGC GGAGCGAGGACACCGCCCTGTACTACTGCGCC ACCGTGTACTACGACAACCCTTGGTTTGTGTAC TGGGGCCAGGGCACCCTGGTGACAGTGTCCGC TGCCAAAACAACAGCACCAAGTGTCTATCCAC TGGCCCCTGTGTGTGGAGATACAACTGGCTCCT CGGTGACTCTAGGATGCCTGGTCAAGGGTTATT TCCCTGAGCCAGTGACCTTGACCTGGAACTCTG GATCCCTGTCCAGTGGTGTGCACACCTTCCCAG CTGTCCTGCAGTCTGACCTCTACACCCTCAGCA GCTCAGTGACTGTAACCTCGAGCACCTGGCCC AGCCAGTCCATCACCTGCAATGTGGCCCACCC GGCAAGCAGCACCAAGGTGGACAAGAAAATT GAGCCCAGAGGGCCCACAATCAAGCCCTGTCC TCCATGCAAATGCCCAGCACCTAACCTCTTGGG TGGACCATCCGTCTTCATCTTCCCTCCAAAGAT CAAGGATGTACTCATGATCTCCCTGAGCCCCAT AGTCACATGTGTGGTGGTGGATGTGAGCGAGG ATGACCCAGATGTCCAGATCAGCTGGTTTGTG AACAACGTGGAAGTACACACAGCTCAGACACA | 1105 |

TABLE 42-continued

H1qC Antibody Heavy Chain CDSs

| mAB/Fab name | Construct ID | Heavy Chain CDS | SEQ ID NO: |
| --- | --- | --- | --- |
| | | AACCCATAGAGAGGATTACAACAGTACTCTCC GGGTGGTCAGTGCCCTCCCCATCCAGCACCAG GACTGGATGAGTGGCAAGGAGTTCAAATGCAA GGTCAACAACAAAGACCTCCCAGCGCCCATCG AGAGAACCATCTCAAACCCAAAGGGTCAGTA AGAGCTCCACAGGTATATGTCTTGCCTCCACCA GAAGAAGAGATGACTAAGAAACAGGTCACTCT GACCTGCATGGTCACAGACTTCATGCCTGAAG ACATTTACGTGGAGTGGACCAACAACGGGAAA ACAGAGCTAAACTACAAGAACACTGAACCAGT CCTGGACTCTGATGGTTCTTACTTCATGTACAG CAAGCTGAGAGTGGAAAAGAAGAACTGGGTG GAAAGAAATAGCTACTCCTGTTCAGTGGTCCA CGAGGGTCTGCACAATCACCACACGACTAAGA GCTTCTCCCGGACTCCGGGTAAA | |
| SM1B206 | pDR000027134 | GAAGTGAAGCTGGTGGAAAGCGGCGGAGGCCT GGTGAAACCTGGCGGCAGCCTGAAGCTGAGCT GCGCCGCCAGCGGCTTCACCTTCAGCAACTAC GCCATGAGCTGGGTCCGCCAGACCCCCGAGAA GCGGCTGGAATGGGTGGCCAGCATCAGCAGAC GGGGCAGCACCTACTACCCCGACAGCGTGAAG GGCCGGTTCACCATCAGCCGGGACAACGCCCG GAACATCCTGTACCTGCAGATGAGCAGCCTGC GGAGCGAGGACACCGCCCTGTACTACTGCGCC ACCGTGTACTACGACAACCCTTGGTTTGTGTAC TGGGGCCAGGGCACCCTGGTGACAGTGTCCGC TGCCAAAACAACAGCACCAAGTGTCTATCCAC TGGCCCCTGTGTGTGGAGATACAACTGGCTCCT CGGTGACTCTAGGATGCCTGGTCAAGGGTTATT TCCCTGAGCCAGTGACCTTGACCTGGAACTCTG GATCCCTGTCCAGTGGTGTGCACACCTTCCCAG CTGTCCTGCAGTCTGACCTCTACACCCTCAGCA GCTCAGTGACTGTAACCTCGAGCACCTGGCCC AGCCAGTCCATCACCTGCAATGTGGCCCACCC GGCAAGCAGCACCAAGGTGGACAAGAAAATT GAGCCCAGAGGGCCCACAATCAAGCCCTGTCC TCCATGCAAATGCCCAGCACCTAACCTCTTGGG TGGACCATCCGTCTTCATCTTCCCTCCAAAGAT CAAGGATGTACTCATGATCTCCCTGAGCCCCAT AGTCACATGTGTGGTGGTGGATGTGAGCGAGG ATGACCCAGATGTCCAGATCAGCTGGTTTGTG AACAACGTGGAAGTACACACAGCTCAGACACA AACCCATAGAGAGGATTACAACAGTACTCTCC GGGTGGTCAGTGCCCTCCCCATCCAGCACCAG GACTGGATGAGTGGCAAGGAGTTCAAATGCAA GGTCAACAACAAAGACCTCCCAGCGCCCATCG AGAGAACCATCTCAAACCCAAAGGGTCAGTA AGAGCTCCACAGGTATATGTCTTGCCTCCACCA GAAGAAGAGATGACTAAGAAACAGGTCACTCT GACCTGCATGGTCACAGACTTCATGCCTGAAG ACATTTACGTGGAGTGGACCAACAACGGGAAA ACAGAGCTAAACTACAAGAACACTGAACCAGT CCTGGACTCTGATGGTTCTTACTTCATGTACAG CAAGCTGAGAGTGGAAAAGAAGAACTGGGTG GAAAGAAATAGCTACTCCTGTTCAGTGGTCCA CGAGGGTCTGCACAATCACCACACGACTAAGA GCTTCTCCCGGACTCCGGGTAAA | 1106 |
| SM1B207 | pDR000027135 | GAAGTGATGCTGGTGGAAAGCGGCGGAGGCCT GGTGAAACCTGGCGGCAGCCTGAAGCTGAGCT GCGCCGCCAGCGGCTTCACCTTCAGCAACTAC GCCATGAGCTGGGTCCGCCAGACCCCCGAGAA GCGGCTGGAATGGGTGGCCAGCATCAGCAGAC GGGGCAGCACCTACTACCCCGACAGCGTGAAG GGCCGGTTCACCATCAGCCGGGACAACGCCCG GAACATCCTGTACCTGCAGATGAGCAGCCTGC GGAGCGAGGACACCGCCCTGTACTACTGCGCC ACCGTGTACTACGACAACCCTTGGTTTGTGTAC TGGGGCCAGGGCACCCTGGTGACAGTGTCCGC TGCCAAAACAACAGCACCAAGTGTCTATCCAC TGGCCCCTGTGTGTGGAGATACAACTGGCTCCT CGGTGACTCTAGGATGCCTGGTCAAGGGTTATT TCCCTGAGCCAGTGACCTTGACCTGGAACTCTG GATCCCTGTCCAGTGGTGTGCACACCTTCCCAG | 1107 |

TABLE 42-continued

H1qC Antibody Heavy Chain CDSs

| mAB/Fab name | Construct ID | Heavy Chain CDS | SEQ ID NO: |
|---|---|---|---|
| | | CTGTCCTGCAGTCTGACCTCTACACCCTCAGCA GCTCAGTGACTGTAACCTCGAGCACCTGGCCC AGCCAGTCCATCACCTGCAATGTGGCCCACCC GGCAAGCAGCACCAAGGTGGACAAGAAAATT GAGCCCAGAGGGCCCACAATCAAGCCCTGTCC TCCATGCAAATGCCCAGCACCTAACCTCTTGGG TGGACCATCCGTCTTCATCTTCCCTCCAAAGAT CAAGGATGTACTCATGATCTCCCTGAGCCCCAT AGTCACATGTGTGGTGGTGGATGTGAGCGAGG ATGACCCAGATGTCCAGATCAGCTGGTTTGTG AACAACGTGGAAGTACACAGCTCAGACACA AACCCATAGAGAGGATTACAACAGTACTCTCC GGGTGGTCAGTGCCCTCCCCATCCAGCACCAG GACTGGATGAGTGGCAAGGAGTTCAAATGCAA GGTCAACAACAAAGACCTCCCAGCGCCCATCG AGAGAACCATCTCAAAACCCAAAGGGTCAGTA AGAGCTCCACAGGTATATGTCTTGCCTCCACCA GAAGAAGAGATGACTAAGAAACAGGTCACTCT GACCTGCATGGTCACAGACTTCATGCCTGAAG ACATTTACGTGGAGTGGACCAACAACGGGAAA ACAGAGCTAAACTACAAGAACACTGAACCAGT CCTGGACTCTGATGGTTCTTACTTCATGTACAG CAAGCTGAGAGTGGAAAAGAAGAACTGGGTG GAAAGAAATAGCTACTCCTGTTCAGTGGTCCA CGAGGGTCTGCACAATCACCACACGACTAAGA GCTTCTCCCGGACTCCGGGTAAA | |

TABLE 43

H1qC Antibody Heavy Chain Primary Transcripts

| mAB/Fab name | Construct ID | Heavy Chain Primary Transcript | SEQ ID NO: |
|---|---|---|---|
| SM1B202 | pDR000027136 | ATGGCTTGGGTGTGGACCTTGCTATTCCTGATG GCAGCTGCCCAAAGTATACAGGCCGAAGTGAT GCTGGTGGAAAGCGGCGGAGGCCTGGTGAAAC CTGGCGGCAGCCTGAAGCTGAGCTGCGCCGCC AGCGGCTTCACCTTCAGCAACTACGCCATGAG CTGGGTCCGCCAGACCCCCGAGAAGCGGCTGG AATGGGTGGCCAGCATCAGCAGACGGGGCAGC ACCTACTACCCCGACAGCGGCAAGGGCCGGTT CACCATCAGCCGGGACAACGCCCCGGAACATCC CCTACCTGCAGATGAGCAGCCTGCGGAGCGAG GACACCGCCCTGTACTACTGCGCCACCGTGTAC TACGACAACCCCTTGGTTTGTGTACTGGGGCCAG GGCACCCTGGTGACAGTGTCCGCTGCCAAAAC AACAGCACCAAGTGTCTATCCACTGGCCCCTGT GTGTGGAGATACAACTGGCTCCTCGGTGACTCT AGGATGCCTGGTCAAGGGTTATTTCCCTGAGCC AGTGACCTTGACCTGGAACTCTGGATCCCTGTC CAGTGGTGTGCACACCTTCCCAGCTGTCCTGCA GTCTGACCTCTACACCCTCAGCAGCTCAGTGAC TGTAACCTCGAGCACCTGGCCCAGCCAGTCCA TCACCTGCAATGTGGCCCACCCGGCAAGCAGC ACCAAGGTGGACAAGAAAATTGAGCCCAGAG GGCCCACAATCAAGCCCTGTCCTCCATGCAAA TGCCCAGCACCTAACCTCTTGGGTGGACCATCC GTCTTCATCTTCCCTCCAAAGATCAAGGATGTA CTCATGATCTCCCTGAGCCCCATAGTCACATGT GTGGTGGTGGATGTGAGCGAGGATGACCCAGA TGTCCAGATCAGCTGGTTTGTGAACAACGTGG AAGTACACAGCTCAGACACAAACCCATAGA GAGGATTACAACAGTACTCTCCGGGTGGTCAG TGCCCTCCCCATCCAGCACCAGGACTGGATGA GTGGCAAGGAGTTCAAATGCAAGGTCAACAAC AAAGACCTCCCAGCGCCCATCGAGAGAACCAT CTCAAAACCCAAAGGGTCAGTAAGAGCTCCAC AGGTATATGTCTTGCCTCCACCAGAAGAAGAG ATGACTAAGAAACAGGTCACTCTGACCTGCAT GGTCACAGACTTCATGCCTGAAGACATTTACGT GGAGTGGACCAACAACGGGAAAACAGAGCTA | 1108 |

TABLE 43-continued

H1qC Antibody Heavy Chain Primary Transcripts

| mAB/Fab name | Construct ID | Heavy Chain Primary Transcript | SEQ ID NO: |
|---|---|---|---|
| | | AACTACAAGAACACTGAACCAGTCCTGGACTC<br>TGATGGTTCTTACTTCATGTACAGCAAGCTGAG<br>AGTGGAAAAGAAGAACTGGGTGGAAAGAAAT<br>AGCTACTCCTGTTCAGTGGTCCACGAGGGTCTG<br>CACAATCACCACACGACTAAGAGCTTCTCCCG<br>GACTCCGGGTAAATGA | |
| SM1B203 | pDR000027135 | ATGGCTTGGGTGTGGACCTTGCTATTCCTGATG<br>GCAGCTGCCCAAAGTATACAGGCCGAAGTGAT<br>GCTGGTGGAAAGCGGCGGAGGCCTGGTGAAAC<br>CTGGCGGCAGCCTGAAGCTGAGCTGCGCCGCC<br>AGCGGCTTCACCTTCAGCAACTACGCCATGAG<br>CTGGGTCCGCCAGACCCCCGAGAAGCGGCTGG<br>AATGGGTGGCCAGCATCAGCAGACGGGGCAGC<br>ACCTACTACCCCGACAGCGTGAAGGGCCGGTT<br>CACCATCAGCCGGGACAACGCCCGGAACATCC<br>TGTACCTGCAGATGAGCAGCCTGCGGAGCGAG<br>GACACCGCCCTGTACTACTGCGCCACCGTGTAC<br>TACGACAACCCTTGGTTTGTGTACTGGGGCCAG<br>GGCACCCTGGTGACAGTGTCCGCTGCCAAAAC<br>AACAGCACCAAGTGTCTATCCACTGGCCCCTGT<br>GTGTGGAGATACAACTGGCTCCTCGGTGACTCT<br>AGGATGCCTGGTCAAGGGTTATTTCCCTGAGCC<br>AGTGACCTTGACCTGGAACTCTGGATCCCTGTC<br>CAGTGGTGTGCACACCTTCCCAGCTGTCCTGCA<br>GTCTGACCTCTACACCCTCAGCAGCTCAGTGAC<br>TGTAACCTCGAGCACCTGGCCCAGCCAGTCCA<br>TCACCTGCAATGTGGCCCACCCGGCAAGCAGC<br>ACCAAGGTGGACAAGAAAATTGAGCCCAGAG<br>GGCCCACAATCAAGCCCTGTCCTCCATGCAAA<br>TGCCCAGCACCTAACCTCTTGGGTGGACCATCC<br>GTCTTCATCTTCCCTCCAAAGATCAAGGATGTA<br>CTCATGATCTCCCTGAGCCCCATAGTCACATGT<br>GTGGTGGTGGATGTGAGCGAGGATGACCCAGA<br>TGTCCAGATCAGCTGGTTTGTGAACAACGTGG<br>AAGTACACACAGCTCAGACACAAACCCATAGA<br>GAGGATTACAACAGTACTCTCCGGGTGGTCAG<br>TGCCCTCCCCATCCAGCACCAGGACTGGATGA<br>GTGGCAAGGAGTTCAAATGCAAGGTCAACAAC<br>AAAGACCTCCCAGCGCCCATCGAGAGAACCAT<br>CTCAAAACCCAAAGGGTCAGTAAGAGCTCCAC<br>AGGTATATGTCTTGCCTCCACCAGAAGAAGAG<br>ATGACTAAGAAACAGGTCACTCTGACCTGCAT<br>GGTCACAGACTTCATGCCTGAAGACATTTACGT<br>GGAGTGGACCAACAACGGGAAAACAGAGCTA<br>AACTACAAGAACACTGAACCAGTCCTGGACTC<br>TGATGGTTCTTACTTCATGTACAGCAAGCTGAG<br>AGTGGAAAAGAAGAACTGGGTGGAAAGAAAT<br>AGCTACTCCTGTTCAGTGGTCCACGAGGGTCTG<br>CACAATCACCACACGACTAAGAGCTTCTCCCG<br>GACTCCGGGTAAATGA | 1109 |
| SM1B204 | pDR000027134 | ATGGCTTGGGTGTGGACCTTGCTATTCCTGATG<br>GCAGCTGCCCAAAGTATACAGGCCGAAGTGAA<br>GCTGGTGGAAAGCGGCGGAGGCCTGGTGAAAC<br>CTGGCGGCAGCCTGAAGCTGAGCTGCGCCGCC<br>AGCGGCTTCACCTTCAGCAACTACGCCATGAG<br>CTGGGTCCGCCAGACCCCCGAGAAGCGGCTGG<br>AATGGGTGGCCAGCATCAGCAGACGGGGCAGC<br>ACCTACTACCCCGACAGCGTGAAGGGCCGGTT<br>CACCATCAGCCGGGACAACGCCCGGAACATCC<br>TGTACCTGCAGATGAGCAGCCTGCGGAGCGAG<br>GACACCGCCCTGTACTACTGCGCCACCGTGTAC<br>TACGACAACCCTTGGTTTGTGTACTGGGGCCAG<br>GGCACCCTGGTGACAGTGTCCGCTGCCAAAAC<br>AACAGCACCAAGTGTCTATCCACTGGCCCCTGT<br>GTGTGGAGATACAACTGGCTCCTCGGTGACTCT<br>AGGATGCCTGGTCAAGGGTTATTTCCCTGAGCC<br>AGTGACCTTGACCTGGAACTCTGGATCCCTGTC<br>CAGTGGTGTGCACACCTTCCCAGCTGTCCTGCA<br>GTCTGACCTCTACACCCTCAGCAGCTCAGTGAC<br>TGTAACCTCGAGCACCTGGCCCAGCCAGTCCA<br>TCACCTGCAATGTGGCCCACCCGGCAAGCAGC<br>ACCAAGGTGGACAAGAAAATTGAGCCCAGAG<br>GGCCCACAATCAAGCCCTGTCCTCCATGCAAA | 1110 |

TABLE 43-continued

HlgC Antibody Heavy Chain Primary Transcripts

| mAB/Fab name | Construct ID | Heavy Chain Primary Transcript | SEQ ID NO: |
|---|---|---|---|
| | | TGCCCAGCACCTAACCTCTTGGGTGGACCATCC<br>GTCTTCATCTTCCCTCCAAAGATCAAGGATGTA<br>CTCATGATCTCCCTGAGCCCCATAGTCACATGT<br>GTGGTGGTGGATGTGAGCGAGGATGACCCAGA<br>TGTCCAGATCAGCTGGTTTGTGAACAACGTGG<br>AAGTACACAGCTCAGACACAAACCCATAGA<br>GAGGATTACAACAGTACTCTCCGGGTGGTCAG<br>TGCCCTCCCCATCCAGCACCAGGACTGGATGA<br>GTGGCAAGGAGTTCAAATGCAAGGTCAACAAC<br>AAAGACCTCCCAGCGCCCATCGAGAGAACCAT<br>CTCAAAACCCAAAGGGTCAGTAAGAGCTCCAC<br>AGGTATATGTCTTGCCTCCACCAGAAGAAGAG<br>ATGACTAAGAAACAGGTCACTCTGACCTGCAT<br>GGTCACAGACTTCATGCCTGAAGACATTTACGT<br>GGAGTGGACCAACAACGGGAAAACAGAGCTA<br>AACTACAAGAACACTGAACCAGTCCTGGACTC<br>TGATGGTTCTTACTTCATGTACAGCAAGCTGAG<br>AGTGGAAAAGAAGAACTGGGTGGAAAGAAAT<br>AGCTACTCCTGTTCAGTGGTCCACGAGGGTCTG<br>CACAATCACCACACGACTAAGAGCTTCTCCCG<br>GACTCCGGGTAAATGA | |
| SM1B205 | pDR000027134 | ATGGCTTGGGTGTGGACCTTGCTATTCCTGATG<br>GCAGCTGCCCAAAGTATACAGGCCGAAGTGAA<br>GCTGGTGGAAAGCGGCGGAGGCCTGGTGAAAC<br>CTGGCGGCAGCCTGAAGCTGAGCTGCGCCGCC<br>AGCGGCTTCACCTTCAGCAACTACGCCATGAG<br>CTGGGTCCGCCAGACCCCCGAGAAGCGGCTGG<br>AATGGGTGGCCAGCATCAGCAGACGGGGCAGC<br>ACCTACTACCCCGACAGCGTGAAGGGCCGGTT<br>CACCATCAGCCGGGACAACGCCCGGAACATCC<br>TGTACCTGCAGATGAGCAGCCTGCGGAGCGAG<br>GACACCGCCCTGTACTACTGCGCCACCGTGTAC<br>TACGACAACCCCTTGGTTTGTGTACTGGGGCCAG<br>GGCACCCTGGTGACAGTGTCCGCTGCCAAAAC<br>AACAGCACCAAGTGTCTATCCACTGGCCCCTGT<br>GTGTGGAGATACAACTGGCCTCCTCGGTGACTCT<br>AGGATGCCTGGTCAAGGGTTATTTCCCTGAGCC<br>AGTGACCTTGACCTGGAACTCTGGATCCCTGTC<br>CAGTGGTGTGCACACCTTCCCAGCTGTCCTGCA<br>GTCTGACCTCTACACCCTCAGCAGCTCAGTGAC<br>TGTAACCTCGAGCACCTGGCCCAGCCAGTCCA<br>TCACCTGCAATGTGGCCCACCCGGCAAGCAGC<br>ACCAAGGTGGACAAGAAAATTGAGCCCAGAG<br>GGCCCACAATCAAGCCCTGTCCTCCATGCAAA<br>TGCCCAGCACCTAACCTCTTGGGTGGACCATCC<br>GTCTTCATCTTCCCTCCAAAGATCAAGGATGTA<br>CTCATGATCTCCCTGAGCCCCATAGTCACATGT<br>GTGGTGGTGGATGTGAGCGAGGATGACCCAGA<br>TGTCCAGATCAGCTGGTTTGTGAACAACGTGG<br>AAGTACACAGCTCAGACACAAACCCATAGA<br>GAGGATTACAACAGTACTCTCCGGGTGGTCAG<br>TGCCCTCCCCATCCAGCACCAGGACTGGATGA<br>GTGGCAAGGAGTTCAAATGCAAGGTCAACAAC<br>AAAGACCTCCCAGCGCCCATCGAGAGAACCAT<br>CTCAAAACCCAAAGGGTCAGTAAGAGCTCCAC<br>AGGTATATGTCTTGCCTCCACCAGAAGAAGAG<br>ATGACTAAGAAACAGGTCACTCTGACCTGCAT<br>GGTCACAGACTTCATGCCTGAAGACATTTACGT<br>GGAGTGGACCAACAACGGGAAAACAGAGCTA<br>AACTACAAGAACACTGAACCAGTCCTGGACTC<br>TGATGGTTCTTACTTCATGTACAGCAAGCTGAG<br>AGTGGAAAAGAAGAACTGGGTGGAAAGAAAT<br>AGCTACTCCTGTTCAGTGGTCCACGAGGGTCTG<br>CACAATCACCACACGACTAAGAGCTTCTCCCG<br>GACTCCGGGTAAATGA | 1111 |
| SM1B206 | pDR000027134 | ATGGCTTGGGTGTGGACCTTGCTATTCCTGATG<br>GCAGCTGCCCAAAGTATACAGGCCGAAGTGAA<br>GCTGGTGGAAAGCGGCGGAGGCCTGGTGAAAC<br>CTGGCGGCAGCCTGAAGCTGAGCTGCGCCGCC<br>AGCGGCTTCACCTTCAGCAACTACGCCATGAG<br>CTGGGTCCGCCAGACCCCCGAGAAGCGGCTGG<br>AATGGGTGGCCAGCATCAGCAGACGGGGCAGC<br>ACCTACTACCCCGACAGCGTGAAGGGCCGGTT | 1112 |

TABLE 43-continued

HlqC Antibody Heavy Chain Primary Transcripts

| mAB/Fab name | Construct ID | Heavy Chain Primary Transcript | SEQ ID NO: |
|---|---|---|---|
| | | CACCATCAGCCGGGACAACGCCCGGAACATCC<br>TGTACCTGCAGATGAGCAGCCTGCGGAGCGAG<br>GACACCGCCCTGTACTACTGCGCCACCGTGTAC<br>TACGACAACCCTTGGTTTGTGTACTGGGGCCAG<br>GGCACCCTGGTGACAGTGTCCGCTGCCAAAAC<br>AACAGCACCAAGTGTCTATCCACTGGCCCCTGT<br>GTGTGGAGATACAACTGGCTCCTCGGTGACTCT<br>AGGATGCCTGGTCAAGGGTTATTTCCCTGAGCC<br>AGTGACCTTGACCTGGAACTCTGGATCCCTGTC<br>CAGTGGTGTGCACACCTTCCCAGCTGTCCTGCA<br>GTCTGACCTCTACACCCTCAGCAGCTCAGTGAC<br>TGTAACCTCGAGCACCTGGCCCAGCCAGTCCA<br>TCACCTGCAATGTGGCCCACCCGGCAAGCAGC<br>ACCAAGGTGGACAAGAAAATTGAGCCCAGAG<br>GGCCCACAATCAAGCCCTGTCCTCCATGCAAA<br>TGCCCAGCACCTAACCTCTTGGGTGGACCATCC<br>GTCTTCATCTTCCCTCCAAAGATCAAGGATGTA<br>CTCATGATCTCCCTGAGCCCCATAGTCACATGT<br>GTGGTGGTGGATGTGAGCGAGGATGACCCAGA<br>TGTCCAGATCAGCTGGTTTGTGAACAACGTGG<br>AAGTACACACAGCTCAGACACAAACCCATAGA<br>GAGGATTACAACAGTACTCTCCGGGTGGTCAG<br>TGCCCTCCCCATCCAGCACCAGGACTGGATGA<br>GTGGCAAGGAGTTCAAATGCAAGGTCAACAAC<br>AAAGACCTCCCAGCGCCCATCGAGAGAACCAT<br>CTCAAAACCCAAAGGGTCAGTAAGAGCTCCAC<br>AGGTATATGTCTTGCCTCCACCAGAAGAAGAG<br>ATGACTAAGAAACAGGTCACTCTGACCTGCAT<br>GGTCACAGACTTCATGCCTGAAGACATTTACGT<br>GGAGTGGACCAACAACGGGAAAACAGAGCTA<br>AACTACAAGAACACTGAACCAGTCCTGGACTC<br>TGATGGTTCTTACTTCATGTACAGCAAGCTGAG<br>AGTGGAAAAGAAGAACTGGGTGGAAAGAAAT<br>AGCTACTCCTGTTCAGTGGTCCACGAGGGTCTG<br>CACAATCACCACACGACTAAGAGCTTCTCCCG<br>GACTCCGGGTAAATGA | |
| SM1B207 | pDR000027135 | ATGGCTTGGGTGTGGACCTTGCTATTCCTGATG<br>GCAGCTGCCCAAAGTATACAGGCCGAAGTGAT<br>GCTGGTGGAAAGCGGCGGAGGCCTGGTGAAAC<br>CTGGCGGCAGCCTGAAGCTGAGCTGCGCCGCC<br>AGCGGCTTCACCTTCAGCAACTACGCCATGAG<br>CTGGGTCCGCCAGACCCCCGAGAAGCGGCTGG<br>AATGGGTGGCCAGCATCAGCAGACGGGGCAGC<br>ACCTACTACCCCGACAGCGTGAAGGGCCGGTT<br>CACCATCAGCCGGGACAACGCCCGGAACATCC<br>TGTACCTGCAGATGAGCAGCCTGCGGAGCGAG<br>GACACCGCCCTGTACTACTGCGCCACCGTGTAC<br>TACGACAACCCTTGGTTTGTGTACTGGGGCCAG<br>GGCACCCTGGTGACAGTGTCCGCTGCCAAAAC<br>AACAGCACCAAGTGTCTATCCACTGGCCCCTGT<br>GTGTGGAGATACAACTGGCTCCTCGGTGACTCT<br>AGGATGCCTGGTCAAGGGTTATTTCCCTGAGCC<br>AGTGACCTTGACCTGGAACTCTGGATCCCTGTC<br>CAGTGGTGTGCACACCTTCCCAGCTGTCCTGCA<br>GTCTGACCTCTACACCCTCAGCAGCTCAGTGAC<br>TGTAACCTCGAGCACCTGGCCCAGCCAGTCCA<br>TCACCTGCAATGTGGCCCACCCGGCAAGCAGC<br>ACCAAGGTGGACAAGAAAATTGAGCCCAGAG<br>GGCCCACAATCAAGCCCTGTCCTCCATGCAAA<br>TGCCCAGCACCTAACCTCTTGGGTGGACCATCC<br>GTCTTCATCTTCCCTCCAAAGATCAAGGATGTA<br>CTCATGATCTCCCTGAGCCCCATAGTCACATGT<br>GTGGTGGTGGATGTGAGCGAGGATGACCCAGA<br>TGTCCAGATCAGCTGGTTTGTGAACAACGTGG<br>AAGTACACACAGCTCAGACACAAACCCATAGA<br>GAGGATTACAACAGTACTCTCCGGGTGGTCAG<br>TGCCCTCCCCATCCAGCACCAGGACTGGATGA<br>GTGGCAAGGAGTTCAAATGCAAGGTCAACAAC<br>AAAGACCTCCCAGCGCCCATCGAGAGAACCAT<br>CTCAAAACCCAAAGGGTCAGTAAGAGCTCCAC<br>AGGTATATGTCTTGCCTCCACCAGAAGAAGAG<br>ATGACTAAGAAACAGGTCACTCTGACCTGCAT<br>GGTCACAGACTTCATGCCTGAAGACATTTACGT<br>GGAGTGGACCAACAACGGGAAAACAGAGCTA | 1113 |

TABLE 43-continued

HlgC Antibody Heavy Chain Primary Transcripts

| mAB/Fab name | Construct ID | Heavy Chain Primary Transcript | SEQ ID NO: |
|---|---|---|---|
| | | AACTACAAGAACACTGAACCAGTCCTGGACTC TGATGGTTCTTACTTCATGTACAGCAAGCTGAG AGTGGAAAAGAAGAACTGGGTGGAAAGAAAT AGCTACTCCTGTTCAGTGGTCCACGAGGGTCTG CACAATCACCACACGACTAAGAGCTTCTCCCG GACTCCGGGTAAATGA | |

TABLE 44

HlgC Antibody Light Chain CDSs

| mAB/Fab name | Construct ID | Light Chain CDS | SEQ ID NO: |
|---|---|---|---|
| SM1B202 | pDR000027142 | GAGACAACCGTGACCCAGAGCCCCGCCAGCCT GAGCGTGGCCACCGGCGAGAAAGTGACCATCC GGTGCATCACCAGCACCGACATCGACGACGAC ATGAGCTGGTATCAGCAGAAGCCCGGCGAGCC CCCCAAGCTGCTGATCAGCGAGGGCAACACCC TGCGGCCTGGCGTGCCCAGCAGATTCAGCAGC AGCGGCTGCGGCACCGACTTCGTGTTCACCATC GAGAACACCCTGAGCGAGGACGTGGCCGACTA CTACTGCCTGCAGAGCGACAACATGCCCTACA CCTTCGGCGGAGGCACCAAGCTGGAAATCAAG CGGGCTGATGCTGCACCGACTGTGTCCATCTTC CCACCATCCAGTGAGCAGTTAACATCTGGAGG TGCCTCAGTCGTGTGCTTCTTGAACAACTTCTA CCCCAAAGACATCAATGTCAAGTGGAAGATTG ATGGCAGTGAACGACAAAATGGCGTCCTGAAC AGTTGGACTGATCAGGACAGCAAAGACAGCAC CTACAGCATGAGCAGCACCCTCACGTTGACCA AGGACGAGTATGAACGACATAACAGCTATACC TGTGAGGCCACTCACAAGACATCAACTTCACC CATTGTCAAGAGCTTCAACAGGAATGAGTGT | 1114 |
| SM1B203 | pDR000027141 | GACATCGTGATGACCCAGAGCCCCGCCACCCT GAGCGTGACCCCTGGCGATAGAGTGTCCCTGA GCTGCCGGGCCAGCCAGAGCATCAGCGACTAC CTGCACTGGTATCAGCAGAAGTCCCACGAGAG CCCCAGACTGCTGATTAAGTACGACAGCCAGT CCATCAGCGGCATCCCCAGCAGATTCAGCGGC AGCGGCTCCGGCTCCGACTTCACCCTGAGCATC AACAGCGTGGAACCCGAGGACGTGGGCGTGTA CTACTGCCAGAACGGCCACCGGTTCCCTTTCAC CTTCGGCGGAGGCACCAAGCTGGAAATCAAGC GGGCTGATGCTGCACCGACTGTGTCCATCTTCC CACCATCCAGTGAGCAGTTAACATCTGGAGGT GCCTCAGTCGTGTGCTTCTTGAACAACTTCTAC CCCAAAGACATCAATGTCAAGTGGAAGATTGA TGGCAGTGAACGACAAAATGGCGTCCTGAACA GTTGGACTGATCAGGACAGCAAAGACAGCACC TACAGCATGAGCAGCACCCTCACGTTGACCAA GGACGAGTATGAACGACATAACAGCTATACCT GTGAGGCCACTCACAAGACATCAACTTCACCC ATTGTCAAGAGCTTCAACAGGAATGAGTGT | 1115 |
| SM1B204 | pDR000027140 | AACATCATGATGACCCAGAGCCCCAGCAGCCT GACCGTGTCTGCCGGCGAGAAAGTGACCATGA GCTGCAAGAGCAGCCAGAGCGTGCTGTACAGC TCCAACCAGAAGAACTACCTGGCCTGGTATCA GCAGAAGCCCGGCCAGTCCCCCAAGCTGCTGA TCTACTGGGCCAGCACCCGCGAGAGCGGCGTG CCCGATAGATTTGCCGGCTCCGGCTCCGGCACC GACTTCACCCTGAGCATCAGCAGCGTGCAGGC CGAGGACCTGGCCGTGTACTACTGCCACCAGT ACCTGAGCAGCTACACCTTCGGCGGAGGCACC AAGCTGGAAATCAAGCGGGCTGATGCTGCACC GACTGTGTCCATCTTCCCACCATCCAGTGAGCA GTTAACATCTGGAGGTGCCTCAGTCGTGTGCTT CTTGAACAACTTCTACCCCAAAGACATCAATGT CAAGTGGAAGATTGATGGCAGTGAACGACAAA ATGGCGTCCTGAACAGTTGGACTGATCAGGAC | 1116 |

TABLE 44-continued

H1qC Antibody Light Chain CDSs

| mAB/Fab name | Construct ID | Light Chain CDS | SEQ ID NO: |
|---|---|---|---|
| | | AGCAAAGACAGCACCTACAGCATGAGCAGCAC CCTCACGTTGACCAAGGACGAGTATGAACGAC ATAACAGCTATACCTGTGAGGCCACTCACAAG ACATCAACTTCACCCATTGTCAAGAGCTTCAAC AGGAATGAGTGT | |
| SM1B205 | pDR000027139 | GACATCGTGCTGACCCAGAGCCCTGCCAGCCT GGCCGTGTCTCTGGGCCAGAGAGCCACCATCA GCTACCGGGCCAGCAAGAGCGTGTCCACCAGC GGCTACAGCTACATGCACTGGAACCAGCAGAA GCCCGGCCAGCCCCCCAGACTGCTGATCTACCT GGTGTCCAACCTGGAAAGCGGCGTGCCCGCCA GATTCTCCGGCAGCGGCTCTGGCACCGACTTCA CCCTGAACATCCACCCCGTGGAAGAAGAGGAC GCCGCCACCTACTACTGCCAGCACATCAGAGA GCTGACCAGAAGCGAGGGCGGCACCAAGCTGG AAATCAAGCGGGCTGATGCTGCACCGACTGTG TCCATCTTCCCACCATCCAGTGAGCAGTTAACA TCTGGAGGTGCCTCAGTCGTGTGCTTCTTGAAC AACTTCTACCCCAAAGACATCAATGTCAAGTG GAAGATTGATGGCAGTGAACGACAAAATGGCG TCCTGAACAGTTGGACTGATCAGGACAGCAAA GACAGCACCTACAGCATGAGCAGCACCCTCAC GTTGACCAAGGACGAGTATGAACGACATAACA GCTATACCTGTGAGGCCACTCACAAGACATCA ACTTCACCCATTGTCAAGAGCTTCAACAGGAA TGAGTGT | 1117 |
| SM1B206 | pDR000027138 | GACATCGTGATGACCCAGAGCCCCGCCACCCT GAGCGTGACCCCTGGCGATAGAGTGTCCCTGA GCTGCCGGGCCAGCCAGAGCATCAGCGACTAC CTGCACTGGTATCAGCAGAAGTCCCACGAGAG CCCCAGACTGCTGATTAAGTACGCCAGCCAGT CCATCTCCGGCATCCCCAGCAGATTCAGCGGC AGCGGCTCCGGCAGCGACTTCACCCTGTCCATC AACAGCGTGGAACCCGAGGACGTGGGCGTGTA CTACTGCCAGAACGGCCACAGCTTCCCCCTGA CCTTCGGCGCTGGCACCAAGCTGGAACTGAAG CGGGCTGATGCTGCACCGACTGTGTCCATCTTC CCACCATCCAGTGAGCAGTTAACATCTGGAGG TGCCTCAGTCGTGTGCTTCTTGAACAACTTCTA CCCCAAAGACATCAATGTCAAGTGGAAGATTG ATGGCAGTGAACGACAAAATGGCGTCCTGAAC AGTTGGACTGATCAGGACAGCAAAGACAGCAC CTACAGCATGAGCAGCACCCTCACGTTGACCA AGGACGAGTATGAACGACATAACAGCTATACC TGTGAGGCCACTCACAAGACATCAACTTCACC CATTGTCAAGAGCTTCAACAGGAATGAGTGT | 1118 |
| SM1B207 | pDR000027137 | GACATCGTGCTGACCCAGAGCCCTGCCAGCCT GGCCGTGTCTCTGGGCCAGAGAGCCACCATCA GCTGCCAGGCCAGCGAGAGCGTGTCCTTCGCC GGCACCAGCCTGATGCACTGGTATCAGCAGAA GCCCGGCCAGAGCCCCAAGCTGCTGATCTACT GGGCCAGCACCCGCGAGAGCGGCGTGCCCGAT AGATTTGCCGGCTCCGGCTCCGGCACCGACTTC ACCCTGAGCATCAGCAGCGTGCAGGCCGAGGA TCTGGCCGTGTACTACTGCCACCAGTACCTGAG CAGCTACACCTTCGGCGGAGGCACCAAGCTGG AAATCAAGCGGGCTGATGCTGCACCGACTGTG TCCATCTTCCCACCATCCAGTGAGCAGTTAACA TCTGGAGGTGCCTCAGTCGTGTGCTTCTTGAAC AACTTCTACCCCAAAGACATCAATGTCAAGTG GAAGATTGATGGCAGTGAACGACAAAATGGCG TCCTGAACAGTTGGACTGATCAGGACAGCAAA GACAGCACCTACAGCATGAGCAGCACCCTCAC GTTGACCAAGGACGAGTATGAACGACATAACA GCTATACCTGTGAGGCCACTCACAAGACATCA ACTTCACCCATTGTCAAGAGCTTCAACAGGAA TGAGTGT | 1119 |

TABLE 45

HlqC Antibody Light Chain Primary Transcripts

| mAB/Fab name | Construct ID | Light Chain Primary Transcript | SEQ ID NO: |
|---|---|---|---|
| SM1B202 | pDR000027142 | ATGGAGACACATTCTCAGGTCTTTGTATACATG TTGCTGTGGTTGTCTGGTGTCGAGGGCGAGAC AACCGTGACCCAGAGCCCCGCCAGCCTGAGCG TGGCCACCGGCGAGAAAGTGACCATCCGGTGC ATCACCAGCACCGACATCGACGACGACATGAG CTGGTATCAGCAGAAGCCCGGCGAGCCCCCA AGCTGCTGATCAGCGAGGGCAACACCCTGCGG CCTGGCGTGCCCAGCAGATTCAGCAGCAGCGG CTGCGGCACCGACTTCGTGTTCACCATCGAGA ACACCCTGAGCGAGGACGTGGCCGACTACTAC TGCCTGCAGAGCGACAACATGCCCTACACCTT CGGCGGAGGCACCAAGCTGGAAATCAAGCGG GCTGATGCTGCACCGACTGTGTCCATCTTCCCA CCATCCAGTGAGCAGTTAACATCTGGAGGTGC CTCAGTCGTGTGCTTCTTGAACAACTTCTACCC CAAAGACATCAATGTCAAGTGGAAGATTGATG GCAGTGAACGACAAAATGGCGTCCTGAACAGT TGGACTGATCAGGACAGCAAAGACAGCACCTA CAGCATGAGCAGCACCCTCACGTTGACCAAGG ACGAGTATGAACGACATAACAGCTATACCTGT GAGGCCACTCACAAGACATCAACTTCACCCAT TGTCAAGAGCTTCAACAGGAATGAGTGTTAG | 1120 |
| SM1B203 | pDR000027141 | ATGGAGACACATTCTCAGGTCTTTGTATACATG TTGCTGTGGTTGTCTGGTGTCGAGGGCGACATC GTGATGACCCAGAGCCCCGCCACCCTGAGCGT GACCCCTGGCGATAGAGTGTCCCTGAGCTGCC GGGCCAGCCAGAGCATCAGCGACTACCTGCAC TGGTATCAGCAGAAGTCCCACGAGAGCCCCAG ACTGCTGATTAAGTACGACAGCCAGTCCATCA GCGGCATCCCCAGCAGATTCAGCGGCAGCGGC TCCGGCTCCGACTTCACCCTGAGCATCAACAG CGTGGAACCCGAGGACGTGGGCGTGTACTACT GCCAGAACGGCCACCGGTTCCCTTTCACCTTCG GCGGAGGCACCAAGCTGGAAATCAAGCGGGCT GATGCTGCACCGACTGTGTCCATCTTCCCACCA TCCAGTGAGCAGTTAACATCTGGAGGTGCCTC AGTCGTGTGCTTCTTGAACAACTTCTACCCCAA AGACATCAATGTCAAGTGGAAGATTGATGGCA GTGAACGACAAAATGGCGTCCTGAACAGTTGG ACTGATCAGGACAGCAAAGACAGCACCTACAG CATGAGCAGCACCCTCACGTTGACCAAGGACG AGTATGAACGACATAACAGCTATACCTGTGAG GCCACTCACAAGACATCAACTTCACCCATTGTC AAGAGCTTCAACAGGAATGAGTGTTAG | 1121 |
| SM1B204 | pDR000027140 | ATGGAGACACATTCTCAGGTCTTTGTATACATG TTGCTGTGGTTGTCTGGTGTCGAGGGCAACATC ATGATGACCCAGAGCCCCAGCAGCCTGACCGT GTCTGCCGGCGAGAAAGTGACCATGAGCTGCA AGAGCAGCCAGAGCGTGCTGTACAGCTCCAAC CAGAAGAACTACCTGGCCTGGTATCAGCAGAA GCCCGGCCAGTCCCCCAAGCTGCTGATCTACT GGGCCAGCACCCGCGAGAGCGGCGTGCCCGAT AGATTTGCCGGCTCCGGCTCCGGCACCGACTTC ACCCTGAGCATCAGCAGCGTGCAGGCCGAGGA CCTGGCCGTGTACTACTGCCACCAGTACCTGA GCAGCTACACCTTCGGCGGAGGCACCAAGCTG GAAATCAAGCGGGCTGATGCTGCACCGACTGT GTCCATCTTCCCACCATCCAGTGAGCAGTTAAC ATCTGGAGGTGCCTCAGTCGTGTGCTTCTTGAA CAACTTCTACCCCAAAGACATCAATGTCAAGT GGAAGATTGATGGCAGTGAACGACAAAATGGC GTCCTGAACAGTTGGACTGATCAGGACAGCAA AGACAGCACCTACAGCATGAGCAGCACCCTCA CGTTGACCAAGGACGAGTATGAACGACATAAC AGCTATACCTGTGAGGCCACTCACAAGACATC AACTTCACCCATTGTCAAGAGCTTCAACAGGA ATGAGTGTTAG | 1122 |
| SM1B205 | pDR000027139 | ATGGAGACACATTCTCAGGTCTTTGTATACATG TTGCTGTGGTTGTCTGGTGTCGAGGGCGACATC GTGCTGACCCAGAGCCCTGCCAGCCTGGCCGT GTCTCTGGGCCAGAGAGCCACCATCAGCTACC GGGCCAGCAAGAGCGTGTCCACCAGCGGCTAC | 1123 |

TABLE 45-continued

H1gC Antibody Light Chain Primary Transcripts

| mAB/Fab name | Construct ID | Light Chain Primary Transcript | SEQ ID NO: |
|---|---|---|---|
| | | AGCTACATGCACTGGAACCAGCAGAAGCCCGG<br>CCAGCCCCCAGACTGCTGATCTACCTGGTGTC<br>CAACCTGGAAAGCGGCGTGCCCGCCAGATTCT<br>CCGGCAGCGGCTCTGGCACCGACTTCACCCTG<br>AACATCCACCCCGTGGAAGAAGAGGACGCCGC<br>CACCTACTACTGCCAGCACATCAGAGAGCTGA<br>CCAGAAGCGAGGGCGGCACCAAGCTGGAAAT<br>CAAGCGGGCTGATGCTGCACCGACTGTGTCCA<br>TCTTCCCACCATCCAGTGAGCAGTTAACATCTG<br>GAGGTGCCTCAGTCGTGTGCTTCTTGAACAACT<br>TCTACCCCAAAGACATCAATGTCAAGTGGAAG<br>ATTGATGGCAGTGAACGACAAAATGGCGTCCT<br>GAACAGTTGGACTGATCAGGACAGCAAAGACA<br>GCACCTACAGCATGAGCAGCACCCTCACGTTG<br>ACCAAGGACGAGTATGAACGACATAACAGCTA<br>TACCTGTGAGGCCACTCACAAGACATCAACTT<br>CACCCATTGTCAAGAGCTTCAACAGGAATGAG<br>TGTTAG | |
| SM1B206 | pDR000027138 | ATGGAGACACATTCTCAGGTCTTTGTATACATG<br>TTGCTGTGGTTGTCTGGTGTCGAGGGCGACATC<br>GTGATGACCCAGAGCCCCGCCACCCTGAGCGT<br>GACCCCTGGCGATAGAGTGTCCCTGAGCTGCC<br>GGGCCAGCCAGAGCATCAGCGACTACCTGCAC<br>TGGTATCAGCAGAAGTCCCACGAGAGCCCCAG<br>ACTGCTGATTAAGTACGCCAGCCAGTCCATCTC<br>CGGCATCCCCAGCAGATTCAGCGGCAGCGGCT<br>CCGGCAGCGACTTCACCCTGTCCATCAACAGC<br>GTGGAACCCGAGGACGTGGGCGTGTACTACTG<br>CCAGAACGGCCACAGCTTCCCCCTGACCTTCG<br>GCGCTGGCACCAAGCTGGAACTGAAGCGGGCT<br>GATGCTGCACCGACTGTGTCCATCTTCCCACCA<br>TCCAGTGAGCAGTTAACATCTGGAGGTGCCTC<br>AGTCGTGTGCTTCTTGAACAACTTCTACCCCAA<br>AGACATCAATGTCAAGTGGAAGATTGATGGCA<br>GTGAACGACAAAATGGCGTCCTGAACAGTTGG<br>ACTGATCAGGACAGCAAAGACAGCACCTACAG<br>CATGAGCAGCACCCTCACGTTGACCAAGGACG<br>AGTATGAACGACATAACAGCTATACCTGTGAG<br>GCCACTCACAAGACATCAACTTCACCCATTGTC<br>AAGAGCTTCAACAGGAATGAGTGTTAG | 1124 |
| SM1B207 | pDR000027137 | ATGGAGACACATTCTCAGGTCTTTGTATACATG<br>TTGCTGTGGTTGTCTGGTGTCGAGGGCGACATC<br>GTGCTGACCCAGAGCCCTGCCAGCCTGGCCGT<br>GTCTCTGGGCCAGAGAGCCACCATCAGCTGCC<br>AGGCCAGCGAGAGCGTGTCCTTCGCCGGCACC<br>AGCCTGATGCACTGGTATCAGCAGAAGCCCGG<br>CCAGAGCCCCAAGCTGCTGATCTACTGGGCCA<br>GCACCCGCGAGAGCGGCGTGCCCGATAGATTT<br>GCCGGCTCCGGCTCCGGCACCGACTTCACCCT<br>GAGCATCAGCAGCGTGCAGGCCGAGGATCTGG<br>CCGTGTACTACTGCCACCAGTACCTGAGCAGC<br>TACACCTTCGGCGGAGGCACCAAGCTGGAAAT<br>CAAGCGGGCTGATGCTGCACCGACTGTGTCCA<br>TCTTCCCACCATCCAGTGAGCAGTTAACATCTG<br>GAGGTGCCTCAGTCGTGTGCTTCTTGAACAACT<br>TCTACCCCAAAGACATCAATGTCAAGTGGAAG<br>ATTGATGGCAGTGAACGACAAAATGGCGTCCT<br>GAACAGTTGGACTGATCAGGACAGCAAAGACA<br>GCACCTACAGCATGAGCAGCACCCTCACGTTG<br>ACCAAGGACGAGTATGAACGACATAACAGCTA<br>TACCTGTGAGGCCACTCACAAGACATCAACTT<br>CACCCATTGTCAAGAGCTTCAACAGGAATGAG<br>TGTTAG | 1125 |

TABLE 46

HlgA/LukE Antibody Heavy Chain CDSs

| Protein AA ID | Construct ID | Heavy ChainCDS | SEQ ID NO: |
|---|---|---|---|
| SM1B302 | pDR000029296 | GAAGTGAAGCTGGTGGAATCTGGCGGCGACCT GGTCAAGCCTGGCGGCAGCCTGAAGCTGAGCT GCGCCGCCAGCGGCTTCACCTTCAGCAGCTTC GCCATGAGCTGGGTCCGACAGACCCCCGAGAA GCGGCTGGAATGGGTGGCCAGCATCAGCCGGA CCGACAACACCTACTACCCCGACAGCATGAAG GGCCAGTTCACCATCAGCCGGGACAACGCCCG GAACATCCTGTACCTGCAGATGAGCAGCCTGC GGAGCGAGAACACCGCCATCTACTACTGCGCC AGAGCCGACTACGACGGCCCTTGGTTTGCCTA CTGGGGCCAGGGCACCCTGGTCACCGTGTCTG CTGCCAAAACAACAGCACCAAGTGTCTATCCA CTGGCCCCTGTGTGTGGAGATACAACTGGCTC CTCGGTGACTCTAGGATGCCTGGTCAAGGGTT ATTTCCCTGAGCCAGTGACCTTGACCTGGAACT CTGGATCCCTGTCCAGTGGTGTGCACACCTTCC CAGCTGTCCTGCAGTCTGACCTCTACACCCTCA GCAGCTCAGTGACTGTAACCTCGAGCACCTGG CCCCAGCCAGTCCATCACCTGCAATGTGGCCCA CCCGGCAAGCAGCACCAAGGTGGACAAGAAA ATTGAGCCCAGAGGGCCCACAATCAAGCCCTG TCCTCCATGCAAATGCCCAGCACCTAACCTCTT GGGTGGACCATCCGTCTTCATCTTCCCTCCAAA GATCAAGGATGTACTCATGATCTCCCTGAGCC CCATAGTCACATGTGTGGTGGTGGATGTGAGC GAGGATGACCCAGATGTCCAGATCAGCTGGTT TGTGAACAACGTGGAAGTACACACAGCTCAGA CACAAACCCATAGAGAGGATTACAACAGTACT CTCCGGGTGGTCAGTGCCCTCCCCATCCAGCAC CAGGACTGGATGAGTGGCAAGGAGTTCAAATG CAAGGTCAACAACAAAGACCTCCCAGCGCCCA TCGAGAGAACCATCTCAAAACCCAAAGGGTCA GTAAGAGCTCCACAGGTATATGTCTTGCCTCCA CCAGAAGAAGAGATGACTAAGAAACAGGTCA CTCTGACCTGCATGGTCACAGACTTCATGCCTG AAGACATTTACGTGGAGTGGACCAACAACGGG AAAACAGAGCTAAACTACAAGAACACTGAACC AGTCCTGGACTCTGATGGTTCTTACTTCATGTA CAGCAAGCTGAGAGTGGAAAAGAAGAACTGG GTGGAAAGAAATAGCTACTCCTGTTCAGTGGT CCACGAGGGTCTGCACAATCACCACACGACTA AGAGCTTCTCCCGGACTCCGGGTAAA | 1126 |
| SM1B303 | pDR000029295 | GAGGTGCAGCTGCAGCAGAGCGGCCCTGATCT GGTCAAGCCCGGCACCAGCGTGAAGATGAGCT GCAAGGCCAGCGGCTACAGCTTCACCGGCTAC TACATGCACTGGGTCAAGCAGAGCCACGGCAA GAGCCTGGAATGGATCGGCAGAGTGAACCCCA ACAACGGCGGCACCAGCTACAACCAGAAGTTC AAGGGCAAGGCCATCCTGACCGTGGACAAGAG CAGCAGCACCGCCTACATGGAACTGCGGAGCC TGACCAGCGAGGACAGCGCCGTGTACTACTGC GCCAGGGACGACTACAGCTTCGCCTACTGGGG CCAGGGCACCCTGGTCACCGTGTCTGCTGCCA AAACAACAGCACCAAGTGTCTATCCACTGGCC CCTGTGTGTGGAGATACAACTGGCTCCTCGGT GACTCTAGGATGCCTGGTCAAGGGTTATTTCCC TGAGCCAGTGACCTTGACCTGGAACTCTGGAT CCCTGTCCAGTGGTGTGCACACCTTCCCAGCTG TCCTGCAGTCTGACCTCTACACCCTCAGCAGCT CAGTGACTGTAACCTCGAGCACCTGGCCCAGC CAGTCCATCACCTGCAATGTGGCCCACCCGGC AAGCAGCACCAAGGTGGACAAGAAAATTGAG CCCAGAGGGCCCACAATCAAGCCCTGTCCTCC ATGCAAATGCCCAGCACCTAACCTCTTGGGTG GACCATCCGTCTTCATCTTCCCTCCAAAGATCA AGGATGTACTCATGATCTCCCTGAGCCCCATA GTCACATGTGTGGTGGTGGATGTGAGCGAGGA TGACCCAGATGTCCAGATCAGCTGGTTTGTGA ACAACGTGGAAGTACACACAGCTCAGACACAA ACCCATAGAGAGGATTACAACAGTACTCTCCG GGTGGTCAGTGCCCTCCCCATCCAGCACCAGG ACTGGATGAGTGGCAAGGAGTTCAAATGCAAG GTCAACAACAAAGACCTCCCAGCGCCCATCGA GAGAACCATCTCAAAACCCAAAGGGTCAGTAA | 1127 |

TABLE 46-continued

HlgA/LukE Antibody Heavy Chain CDSs

| Protein AA ID | Construct ID | Heavy ChainCDS | SEQ ID NO: |
|---|---|---|---|
| | | GAGCTCCACAGGTATATGTCTTGCCTCCACCAG<br>AAGAAGAGATGACTAAGAAACAGGTCACTCTG<br>ACCTGCATGGTCACAGACTTCATGCCTGAAGA<br>CATTTACGTGGAGTGGACCAACAACGGGAAAA<br>CAGAGCTAAACTACAAGAACACTGAACCAGTC<br>CTGGACTCTGATGGTTCTTACTTCATGTACAGC<br>AAGCTGAGAGTGGAAAAGAAGAACTGGGTGG<br>AAAGAAATAGCTACTCCTGTTCAGTGGTCCAC<br>GAGGGTCTGCACAATCACCACACGACTAAGAG<br>CTTCTCCCGGACTCCGGGTAAA | |
| SM1B304 | pDR000029294 | GAAGTGAAGCTGGTGGAAAGCGGCGGAGGCC<br>TGGTGCAGCCTGGCGGCAGCCTGAGACTGAGC<br>TGCGCCACCAGCGGCTTCACCTTCACCGACTTC<br>TACATGAGCTGGGTCCGACAGCCCCCTGGCAA<br>GGCCCTGGAATGGCTGGCCTTCATCCGGAACA<br>AGGCCAACGGCTACACCACCGAGTACAGCAGC<br>AGCGTGCGGGGCAGATTCACCATCAGCCGGGA<br>CAACAGCCAGAGCATCCTGTACCTGCAGATGA<br>ACACCCTGCGGGCCGAGGACAGCGGCACCTAC<br>TACTGCGCCAGGGACGTGGGCGACTACGACTA<br>CTGGGGCCAGGGCAGCACCCTGACCGTGTCCT<br>CTGCCAAAACAACAGCACCAAGTGTCTATCCA<br>CTGGCCCCTGTGTGTGGAGATACAACTGGCTC<br>CTCGGTGACTCTAGGATGCCTGGTCAAGGGTT<br>ATTTCCCTGAGCCAGTGACCTTGACCTGGAACT<br>CTGGATCCCTGTCCAGTGGTGTGCACACCTTCC<br>CAGCTGTCCTGCAGTCTGACCTCTACACCCTCA<br>GCAGCTCAGTGACTGTAACCTCGAGCACCTGG<br>CCCAGCCAGTCCATCACCTGCAATGTGGCCCA<br>CCCGGCAAGCAGCACCAAGGTGGACAAGAAA<br>ATTGAGCCCAGAGGGCCCACAATCAAGCCCTG<br>TCCTCCATGCAAATGCCCAGCACCTAACCTCTT<br>GGGTGGACCATCCGTCTTCATCTTCCCTCCAAA<br>GATCAAGGATGTACTCATGATCTCCCTGAGCC<br>CCATAGTCACATGTGTGGTGGTGGATGTGAGC<br>GAGGATGACCCAGATGTCCAGATCAGCTGGTT<br>TGTGAACAACGTGGAAGTACACACAGCTCAGA<br>CACAAACCCATAGAGAGGATTACAACAGTACT<br>CTCCGGGTGGTCAGTGCCCTCCCCATCCAGCAC<br>CAGGACTGGATGAGTGGCAAGGAGTTCAAATG<br>CAAGGTCAACAACAAAGACCTCCCAGCGCCCA<br>TCGAGAGAACCATCTCAAAACCCAAAGGGTCA<br>GTAAGAGCTCCACAGGTATATGTCTTGCCTCCA<br>CCAGAAGAAGAGATGACTAAGAAACAGGTCA<br>CTCTGACCTGCATGGTCACAGACTTCATGCCTG<br>AAGACATTTACGTGGAGTGGACCAACAACGGG<br>AAAACAGAGCTAAACTACAAGAACACTGAACC<br>AGTCCTGGACTCTGATGGTTCTTACTTCATGTA<br>CAGCAAGCTGAGAGTGGAAAAGAAGAACTGG<br>GTGGAAAGAAATAGCTACTCCTGTTCAGTGGT<br>CCACGAGGGTCTGCACAATCACCACACGACTA<br>AGAGCTTCTCCCGGACTCCGGGTAAA | 1128 |
| SM1B305 | pDR000029293 | CAGATCCAGCTGGTGCAGAGCGGCCCTGAGCT<br>GAAGAAACCCGGCGAGACAGTGAAGATCAGC<br>TGCAAGGCCAGCGGCTTCACCTTCACCAACTA<br>CGGCATGAACTGGGTCAAGCAGGCCCCTGGCA<br>AGGACCTGAAGTGGATGGGCTGGATCAACACC<br>TACACCGGCGAGCCCACCTACGCCGACGACTT<br>CAAGGGCAGATTCGCCTTCAGCCTGGAAACCA<br>GCGCCAGCACCGCCTACCTGCAGATCAACAAC<br>CTGAAGGACGAGGATACCGCCAGCTACTTCTG<br>CGCCAGAGACTACCGGGACGGCGACGCCCTGG<br>ATTACTGGGGCCAGGGCACCAGCGTGACCGTG<br>TCCTCTGCCAAAACAACAGCACCAAGTGTCTA<br>TCCACTGGCCCCTGTGTGTGGAGATACAACTG<br>GCTCCTCGGTGACTCTAGGATGCCTGGTCAAG<br>GGTTATTTCCCTGAGCCAGTGACCTTGACCTGG<br>AACTCTGGATCCCTGTCCAGTGGTGTGCACACC<br>TTCCCAGCTGTCCTGCAGTCTGACCTCTACACC<br>CTCAGCAGCTCAGTGACTGTAACCTCGAGCAC<br>CTGGCCCAGCCAGTCCATCACCTGCAATGTGG<br>CCCACCCGGCAAGCAGCACCAAGGTGGACAAG<br>AAAATTGAGCCCAGAGGGCCCACAATCAAGCC | 1129 |

TABLE 46-continued

HlgA/LukE Antibody Heavy Chain CDSs

| Protein AA ID | Construct ID | Heavy ChainCDS | SEQ ID NO: |
|---|---|---|---|
| | | CTGTCCTCCATGCAAATGCCCAGCACCTAACCT CTTGGGTGGACCATCCGTCTTCATCTTCCCTCC AAAGATCAAGGATGTACTCATGATCTCCCTGA GCCCCATAGTCACATGTGTGGTGGTGGATGTG AGCGAGGATGACCCAGATGTCCAGATCAGCTG GTTTGTGAACAACGTGGAAGTACACACAGCTC AGACACAAACCCATAGAGAGGATTACAACAGT ACTCTCCGGGTGGTCAGTGCCCTCCCCATCCAG CACCAGGACTGGATGAGTGGCAAGGAGTTCAA ATGCAAGGTCAACAACAAAGACCTCCCAGCGC CCATCGAGAGAACCATCTCAAAACCCAAAGGG TCAGTAAGAGCTCCACAGGTATATGTCTTGCCT CCACCAGAAGAAGAGATGACTAAGAAACAGG TCACTCTGACCTGCATGGTCACAGACTTCATGC CTGAAGACATTTACGTGGAGTGGACCAACAAC GGGAAAACAGAGCTAAACTACAAGAACACTG AACCAGTCCTGGACTCTGATGGTTCTTACTTCA TGTACAGCAAGCTGAGAGTGGAAAAGAAGAA CTGGGTGGAAAGAAATAGCTACTCCTGTTCAG TGGTCCACGAGGGTCTGCACAATCACCACACG ACTAAGAGCTTCTCCCGGACTCCGGGTAAA | |
| SM1B306 | pDR000029292 | CAGGTGCAGCTGCAGCAGCCTGGCGCCGAACT CGTCAGACCTGGCGCCAGCGTGAAGCTGAGCT GCAAGGCCAGCGGCTACAGCTTCACCAGCAAC TGGATGAATTGGATGAAGCAGCGGCCTGGCCA GGGCCTGGAATGGATCGGCATGATCCACCCCA GCGACAGCGAGAGCCGGCTGAACCAGAAGTTC AAGGACAAGGCCACCCTGACCGTGGACAAGA GCAGCAGCACCGCCTACATGCAGCTGTCCAGC CCCACCAGCGAGGACAGCGCCGTGTACTACTG TGCCAGAGGCGACGGCGGCTTCGCCTACTGGG GACAGGGCACCCTGGTCACCGTGTCCGCTGCC AAAACAACAGCACCAAGTGTCTATCCACTGGC CCCTGTGTGTGGAGATACAACTGGCTCCTCGGT GACTCTAGGATGCCTGGTCAAGGGTTATTTCCC TGAGCCAGTGACCTTGACCTGGAACTCTGGAT CCCTGTCCAGTGGTGTGCACACCTTCCCAGCTG TCCTGCAGTCTGACCTCTACACCCTCAGCAGCT CAGTGACTGTAACCTCGAGCACCTGGCCCAGC CAGTCCATCACCTGCAATGTGGCCCACCCGGC AAGCAGCACCAAGGTGGACAAGAAAATTGAG CCCAGAGGGCCCACAATCAAGCCCTGTCCTCC ATGCAAATGCCCAGCACCTAACCTCTTGGGTG GACCATCCGTCTTCATCTTCCCTCCAAAGATCA AGGATGTACTCATGATCTCCCTGAGCCCCATA GTCACATGTGTGGTGGTGGATGTGAGCGAGGA TGACCCAGATGTCCAGATCAGCTGGTTTGTGA ACAACGTGGAAGTACACACAGCTCAGACACAA ACCCATAGAGAGGATTACAACAGTACTCTCCG GGTGGTCAGTGCCCTCCCCATCCAGCACCAGG ACTGGATGAGTGGCAAGGAGTTCAAATGCAAG GTCAACAACAAAGACCTCCCAGCGCCCATCGA GAGAACCATCTCAAAACCCAAAGGGTCAGTAA GAGCTCCACAGGTATATGTCTTGCCTCCACCAG AAGAAGAGATGACTAAGAAACAGGTCACTCTG ACCTGCATGGTCACAGACTTCATGCCTGAAGA CATTTACGTGGAGTGGACCAACAACGGGAAAA CAGAGCTAAACTACAAGAACACTGAACCAGTC CTGGACTCTGATGGTTCTTACTTCATGTACAGC AAGCTGAGAGTGGAAAAGAAGAACTGGGTGG AAAGAAATAGCTACTCCTGTTCAGTGGTCCAC GAGGGTCTGCACAATCACCACACGACTAAGAG CTTCTCCCGGACTCCGGGTAAA | 1130 |
| SM1B307 | pDR000029291 | GAAGTGAAGCTGCAGCAGAGCGGCCCTGAGCT GGTCAAGCCTGGCGCCAGCATGAAGATCAGCT GCAAGGCCAGCGGCTACAGCTTCACCGGCTAC ACCATGAACTGGGCCAAGCAGAGCCACGGCAA GAACCTGGAATGGATCGGCCTGATCAACCCCT ACAACGGCGGCACCAGCTACAACCAGAAGTTC AAGGGCAAGGCCACCCTGACCGTGGACAAGA GCAGCAGCACCGCCTACATGGAACTGCTGAGC CTGACCAGCGAGGACAGCGCCGTGTACTACTG CGCCAGAGGCTACCCCAGAGGATGGTTCGCCT | 1131 |

TABLE 46-continued

HlgA/LukE Antibody Heavy Chain CDSs

| Protein AA ID | Construct ID | Heavy ChainCDS | SEQ ID NO: |
|---|---|---|---|
| | | ACTGGGGCCAGGGCACCCTGGTCACCGTGTCT<br>GCTGCCAAAACAACAGCACCAAGTGTCTATCC<br>ACTGGCCCCTGTGTGTGGAGATACAACTGGCT<br>CCTCGGTGACTCTAGGATGCCTGGTCAAGGGT<br>TATTTCCCTGAGCCAGTGACCTTGACCTGGAAC<br>TCTGGATCCCTGTCCAGTGGTGTGCACACCTTC<br>CCAGCTGTCCTGCAGTCTGACCTCTACACCCTC<br>AGCAGCTCAGTGACTGTAACCTCGAGCACCTG<br>GCCCAGCCAGTCCATCACCTGCAATGTGGCCC<br>ACCCGGCAAGCAGCACCAAGGTGGACAAGAA<br>AATTGAGCCCAGAGGGCCCACAATCAAGCCCT<br>GTCCTCCATGCAAATGCCCAGCACCTAACCTCT<br>TGGGTGGACCATCCGTCTTCATCTTCCCTCCAA<br>AGATCAAGGATGTACTCATGATCTCCCTGAGC<br>CCCATAGTCACATGTGTGGTGGTGGATGTGAG<br>CGAGGATGACCCAGATGTCCAGATCAGCTGGT<br>TTGTGAACAACGTGGAAGTACACACAGCTCAG<br>ACACAAACCCATAGAGAGGATTACAACAGTAC<br>TCTCCGGGTGGTCAGTGCCCTCCCCATCCAGCA<br>CCAGGACTGGATGAGTGGCAAGGAGTTCAAAT<br>GCAAGGTCAACAACAAAGACCTCCCAGCGCCC<br>ATCGAGAGAACCATCTCAAAACCCAAAGGGTC<br>AGTAAGAGCTCCACAGGTATATGTCTTGCCTCC<br>ACCAGAAGAAGAGATGACTAAGAAACAGGTC<br>ACTCTGACCTGCATGGTCACAGACTTCATGCCT<br>GAAGACATTTACGTGGAGTGGACCAACAACGG<br>GAAAACAGAGCTAAACTACAAGAACACTGAA<br>CCAGTCCTGGACTCTGATGGTTCTTACTTCATG<br>TACAGCAAGCTGAGAGTGGAAAAGAAGAACT<br>GGGTGGAAAGAAATAGCTACTCCTGTTCAGTG<br>GTCCACGAGGGTCTGCACAATCACCACACGAC<br>TAAGAGCTTCTCCCGGACTCCGGGTAAA | |
| SM1B308 | pDR000029290 | GACGTGAAGCTGGTGGAAAGCGGCGGAGGCCT<br>GGTCAAGCCTGGCGGCAGCCTGAAGCTGAGCT<br>GCGCCGCCAGCGGCTTCACCTTCCGGAACCAC<br>GCCATGAGCTGGGTCCGACAGACCCCCGAGAA<br>GCGGCTGGAATGGGTGGCCGCCATCAACGTGA<br>ACGCCGGCAGCACCTACTACCCCGACACCGTG<br>AAGGACCGGTTCACCATCAGCCGGGACAACGC<br>CAAGAACACCCTGTACCTGCAGATGAGCAGCC<br>TGCGGAGCGAGGACACCGCCCTGTACTACTGC<br>GCCAGACACCGGGCCTACTACAACTACGACGA<br>GAACGCCATGGACTACTGGGGCCAGGGCACCA<br>GCGTGACCGTGTCCTCTGCCAAAACAACAGCA<br>CCAAGTGTCTATCCACTGGCCCCTGTGTGTGGA<br>GATACAACTGGCTCCTCGGTGACTCTAGGATG<br>CCTGGTCAAGGGTTATTTCCCTGAGCCAGTGAC<br>CTTGACCTGGAACTCTGGATCCCTGTCCAGTGG<br>TGTGCACACCTTCCCAGCTGTCCTGCAGTCTGA<br>CCTCTACACCCTCAGCAGCTCAGTGACTGTAAC<br>CTCGAGCACCTGGCCCAGCCAGTCCATCACCT<br>GCAATGTGGCCCACCCGGCAAGCAGCACCAAG<br>GTGGACAAGAAAATTGAGCCCAGAGGGCCCAC<br>AATCAAGCCCTGTCCTCCATGCAAATGCCCAG<br>CACCTAACCTCTTGGGTGGACCATCCGTCTTCA<br>TCTTCCCTCCAAAGATCAAGGATGTACTCATGA<br>TCTCCCTGAGCCCCATAGTCACATGTGTGGTGG<br>TGGATGTGAGCGAGGATGACCCAGATGTCCAG<br>ATCAGCTGGTTTGTGAACAACGTGGAAGTACA<br>CACAGCTCAGACACAAACCCATAGAGAGGATT<br>ACAACAGTACTCTCCGGGTGGTCAGTGCCCTC<br>CCCATCCAGCACCAGGACTGGATGAGTGGCAA<br>GGAGTTCAAATGCAAGGTCAACAACAAAGACC<br>TCCCAGCGCCCATCGAGAGAACCATCTCAAAA<br>CCCAAAGGGTCAGTAAGAGCTCCACAGGTATA<br>TGTCTTGCCTCCACCAGAAGAAGAGATGACTA<br>AGAAACAGGTCACTCTGACCTGCATGGTCACA<br>GACTTCATGCCTGAAGACATTTACGTGGAGTG<br>GACCAACAACGGGAAAACAGAGCTAAACTAC<br>AAGAACACTGAACCAGTCCTGGACTCTGATGG<br>TTCTTACTTCATGTACAGCAAGCTGAGAGTGG<br>AAAAGAAGAACTGGGTGGAAAGAAATAGCTA<br>CTCCTGTTCAGTGGTCCACGAGGGTCTGCACA | 1132 |

TABLE 46-continued

HlgA/LukE Antibody Heavy Chain CDSs

| Protein AA ID | Construct ID | Heavy ChainCDS | SEQ ID NO: |
|---|---|---|---|
| | | ATCACCACACGACTAAGAGCTTCTCCCGGACT CCGGGTAAA | |
| SM1B309 | pDR000029289 | GAGGTGCAGCTGCAGCAGAGCGGCCCTGAGCT GGTCAAGCCCGGCGACAGCGTGAAGATGAGCT GCAAGGCCAGCGGCTACACCTTCACCGACTAC TACATCGACTGGATGAAGCAGAGCCACGGCAA GAGCCTGGAATGGATCGGCTACATCTACCCCA ACAACGGCGGCACCAGCTACAACCAGAACTTC AAGGACAAGGCCACCCTGACCGTGGACAAGA GCAGCAGCACCGCCTACATGGAACTGCACAGC CTGACCAGCGAGGACAGCGCCGTGTACTACTG CGCCAGACTGACCTACTACGCCAAGGTGGACA GCTGGGGCCAGGGCACCAGCGTGACCGTGTCT AGCGCCAAAACAACAGCACCAAGTGTCTATCC ACTGGCCCCTGTGTGTGGAGATACAACTGGCT CCTCGGTGACTCTAGGATGCCTGGTCAAGGGT TATTTCCCTGAGCCAGTGACCTTGACCTGGAAC TCTGGATCCCTGTCCAGTGGTGTGCACACCTTC CCAGCTGTCCTGCAGTCTGACCTCTACACCCTC AGCAGCTCAGTGACTGTAACCTCGAGCACCTG GCCCAGCCAGTCCATCACCTGCAATGTGGCCC ACCCGGCAAGCAGCACCAAGGTGGACAAGAA AATTGAGCCCAGAGGGCCCACAATCAAGCCCT GTCCTCCATGCAAATGCCCAGCACCTAACCTCT TGGGTGGACCATCCGTCTTCATCTTCCCTCCAA AGATCAAGGATGTACTCATGATCTCCCTGAGC CCCATAGTCACATGTGTGGTGGTGGATGTGAG CGAGGATGACCCAGATGTCCAGATCAGCTGGT TTGTGAACAACGTGGAAGTACACACAGCTCAG ACACAAACCCATAGAGAGGATTACAACAGTAC TCTCCGGGTGGTCAGTGCCCTCCCCATCCAGCA CCAGGACTGGATGAGTGGCAAGGAGTTCAAAT GCAAGGTCAACAACAAAGACCTCCCAGCGCCC ATCGAGAGAACCATCTCAAAACCCAAAGGGTC AGTAAGAGCTCCACAGGTATATGTCTTGCCTCC ACCAGAAGAAGAGATGACTAAGAAACAGGTC ACTCTGACCTGCATGGTCACAGACTTCATGCCT GAAGACATTTACGTGGAGTGGACCAACAACGG GAAAACAGAGCTAAACTACAAGAACACTGAA CCAGTCCTGGACTCTGATGGTTCTTACTTCATG TACAGCAAGCTGAGAGTGGAAAAGAAGAACT GGGTGGAAAGAAATAGCTACTCCTGTTCAGTG GTCCACGAGGGTCTGCACAATCACCACACGAC TAAGAGCTTCTCCCGGACTCCGGGTAAA | 1133 |
| SM1B310 | pDR000029288 | GACGTGAAGCTGGTGGAAAGCGGCGGAGGCCT GGTGGAATGGGAGGGCGTGCTGAAGCTGAGCT GCGCCGCCAGCGGCTTCACCTTCAGCAGCTAC GCCATGAGCTGGGTCCGACAGACCCCCGAGAA GCGGCTGGAATGGGTGGCCGCCATCAACAGCA ACGGCGGCAGCACCTACTACCCCGACACCGTG AAGGACCGGTTCACCATCAGCCGGGACAACGC CAAGAACACCCTGTACCTGCAGATGAGCAGCC TGCGGAGCGAGGACACCGCCCTGTACTACTGC GCCAGACTGTACTACGGCGACTACTGGGGCCA GGGCACCACCCTGACCGTGTCCTCTGCCAAAA CAACAGCACCAAGTGTCTATCCACTGGCCCCT GTGTGTGGAGATACAACTGGCTCCTCGGTGAC TCTAGGATGCCTGGTCAAGGGTTATTTCCCTGA GCCAGTGACCTTGACCTGGAACTCTGGATCCCT GTCCAGTGGTGTGCACACCTTCCCAGCTGTCCT GCAGTCTGACCTCTACACCCTCAGCAGCTCAGT GACTGTAACCTCGAGCACCTGGCCCAGCCAGT CCATCACCTGCAATGTGGCCCACCCGGCAAGC AGCACCAAGGTGGACAAGAAATTGAGCCCA GAGGGCCCACAATCAAGCCCTGTCCTCCATGC AAATGCCCAGCACCTAACCTCTTGGGTGGACC ATCCGTCTTCATCTTCCCTCCAAAGATCAAGGA TGTACTCATGATCTCCCTGAGCCCCATAGTCAC ATGTGTGGTGGTGGATGTGAGCGAGGATGACC CAGATGTCCAGATCAGCTGGTTTGTGAACAAC GTGGAAGTACACACAGCTCAGACACAAACCCA TAGAGAGGATTACAACAGTACTCTCCGGGTGG TCAGTGCCCTCCCCATCCAGCACCAGGACTGG | 1134 |

TABLE 46-continued

HlgA/LukE Antibody Heavy Chain CDSs

| Protein AA ID | Construct ID | Heavy ChainCDS | SEQ ID NO: |
|---|---|---|---|
| | | ATGAGTGGCAAGGAGTTCAAATGCAAGGTCAA CAACAAAGACCTCCCAGCGCCCATCGAGAGAA CCATCTCAAAACCCAAAGGGTCAGTAAGAGCT CCACAGGTATATGTCTTGCCTCCACCAGAAGA AGAGATGACTAAGAAACAGGTCACTCTGACCT GCATGGTCACAGACTTCATGCCTGAAGACATT TACGTGGAGTGGACCAACAACGGGAAAACAG AGCTAAACTACAAGAACACTGAACCAGTCCTG GACTCTGATGGTTCTTACTTCATGTACAGCAAG CTGAGAGTGGAAAAGAAGAACTGGGTGGAAA GAAATAGCTACTCCTGTTCAGTGGTCCACGAG GGTCTGCACAATCACCACACGACTAAGAGCTT CTCCCGGACTCCGGGTAAA | |
| SM1B311 | pDR000029287 | CAGGTGCAGCTGAAGCAGAGCGGCCCTAGCCT GGTGCAGCCCAGCCAGAGCCTGAGCATCACCT GTACCGTGTCCGGCTTCAGCCTGACCACCTACG GCCTGCACTGGATCCGGCAGAGCCCCGGCAAG GGCCTGGAATGGCTGGGAGTGATTTGGAGAGG CGGCACCACCGACTACAACGCCGCCTTCATGA GCCGGCTGACCATCACCAAGGACAACAGCAAG AGCCAGGTGTTCTTCAAGATGAACAGCCTGCA GGCCGACGACACCGCCATCTACTACTGCGCCC GGACCGACATCTGGGGCGCTGGCACCACCGTG ACCGTGTCCTCTGCCAAAACAACAGCACCAAG TGTCTATCCACTGGCCCTGTGTGTGGAGATAC AACTGGCTCCTCGGTGACTCTAGGATGCCTGGT CAAGGGTTATTTCCCTGAGCCAGTGACCTTGAC CTGGAACTCTGGATCCCTGTCCAGTGGTGTGCA CACCTTCCCAGCTGTCCTGCAGTCTGACCTCTA CACCCTCAGCAGCTCAGTGACTGTAACCTCGA GCACCTGGCCCAGCCAGTCCATCACCTGCAAT GTGGCCCACCCGGCAAGCAGCACCAAGGTGGA CAAGAAAATTGAGCCCAGAGGGCCCACAATCA AGCCCTGTCCTCCATGCAAATGCCCAGCACCT AACCTCTTGGGTGGACCATCCGTCTTCATCTTC CCTCCAAAGATCAAGGATGTACTCATGATCTC CCTGAGCCCCATAGTCACATGTGTGGTGGTGG ATGTGAGCGAGGATGACCCAGATGTCCAGATC AGCTGGTTTGTGAACAACGTGGAAGTACACAC AGCTCAGACACAAACCCATAGAGAGGATTACA ACAGTACTCTCCGGGTGGTCAGTGCCCTCCCCA TCCAGCACCAGGACTGGATGAGTGGCAAGGAG TTCAAATGCAAGGTCAACAACAAAGACCTCCC AGCGCCCATCGAGAGAACCATCTCAAAACCCA AAGGGTCAGTAAGAGCTCCACAGGTATATGTC TTGCCTCCACCAGAAGAAGAGATGACTAAGAA ACAGGTCACTCTGACCTGCATGGTCACAGACT TCATGCCTGAAGACATTTACGTGGAGTGGACC AACAACGGGAAAACAGAGCTAAACTACAAGA ACACTGAACCAGTCCTGGACTCTGATGGTTCTT ACTTCATGTACAGCAAGCTGAGAGTGGAAAAG AAGAACTGGGTGGAAAGAAATAGCTACTCCTG TTCAGTGGTCCACGAGGGTCTGCACAATCACC ACACGACTAAGAGCTTCTCCCGGACTCCGGGT AAA | 1135 |
| SM1B312 | pDR000029287 | CAGGTGCAGCTGAAGCAGAGCGGCCCTAGCCT GGTGCAGCCCAGCCAGAGCCTGAGCATCACCT GTACCGTGTCCGGCTTCAGCCTGACCACCTACG GCCTGCACTGGATCCGGCAGAGCCCCGGCAAG GGCCTGGAATGGCTGGGAGTGATTTGGAGAGG CGGCACCACCGACTACAACGCCGCCTTCATGA GCCGGCTGACCATCACCAAGGACAACAGCAAG AGCCAGGTGTTCTTCAAGATGAACAGCCTGCA GGCCGACGACACCGCCATCTACTACTGCGCCC GGACCGACATCTGGGGCGCTGGCACCACCGTG ACCGTGTCCTCTGCCAAAACAACAGCACCAAG TGTCTATCCACTGGCCCTGTGTGTGGAGATAC AACTGGCTCCTCGGTGACTCTAGGATGCCTGGT CAAGGGTTATTTCCCTGAGCCAGTGACCTTGAC CTGGAACTCTGGATCCCTGTCCAGTGGTGTGCA CACCTTCCCAGCTGTCCTGCAGTCTGACCTCTA CACCCTCAGCAGCTCAGTGACTGTAACCTCGA GCACCTGGCCCAGCCAGTCCATCACCTGCAAT | 1136 |

TABLE 46-continued

HlgA/LukE Antibody Heavy Chain CDSs

| Protein AA ID | Construct ID | Heavy ChainCDS | SEQ ID NO: |
|---|---|---|---|
| | | GTGGCCCACCCGGCAAGCAGCACCAAGGTGGA<br>CAAGAAAATTGAGCCCAGAGGGCCCACAATCA<br>AGCCCTGTCCTCCATGCAAATGCCCAGCACCT<br>AACCTCTTGGGTGGACCATCCGTCTTCATCTTC<br>CCTCCAAAGATCAAGGATGTACTCATGATCTC<br>CCTGAGCCCCATAGTCACATGTGTGGTGGTGG<br>ATGTGAGCGAGGATGACCCAGATGTCCAGATC<br>AGCTGGTTTGTGAACAACGTGGAAGTACACAC<br>AGCTCAGACACAAACCCATAGAGAGGATTACA<br>ACAGTACTCTCCGGGTGGTCAGTGCCCTCCCCA<br>TCCAGCACCAGGACTGGATGAGTGGCAAGGAG<br>TTCAAATGCAAGGTCAACAACAAAGACCTCCC<br>AGCGCCCATCGAGAGAACCATCTCAAAACCCA<br>AAGGGTCAGTAAGAGCTCCACAGGTATATGTC<br>TTGCCTCCACCAGAAGAAGAGATGACTAAGAA<br>ACAGGTCACTCTGACCTGCATGGTCACAGACT<br>TCATGCCTGAAGACATTTACGTGGAGTGGACC<br>AACAACGGGAAAACAGAGCTAAACTACAAGA<br>ACACTGAACCAGTCCTGGACTCTGATGGTTCTT<br>ACTTCATGTACAGCAAGCTGAGAGTGGAAAAG<br>AAGAACTGGGTGGAAAGAAATAGCTACTCCTG<br>TTCAGTGGTCCACGAGGGTCTGCACAATCACC<br>ACACGACTAAGAGCTTCTCCCGGACTCCGGGT<br>AAA | |
| SM1B313 | pDR000029287 | CAGGTGCAGCTGAAGCAGAGCGGCCCTAGCCT<br>GGTGCAGCCCAGCCAGAGCCTGAGCATCACCT<br>GTACCGTGTCCGGCTTCAGCCTGACCACCTACG<br>GCCTGCACTGGATCCGGCAGAGCCCCGGCAAG<br>GGCCTGGAATGGCTGGGAGTGATTTGGAGAGG<br>CGGCACCACCGACTACAACGCCGCCTTCATGA<br>GCCGGCTGACCATCACCAAGGACAACAGCAAG<br>AGCCAGGTGTTCTTCAAGATGAACAGCCTGCA<br>GGCCGACGACACCGCCATCTACTACTGCGCCC<br>GGACCGACATCTGGGGCGCTGGCACCACCGTG<br>ACCGTGTCCTCTGCCAAAACAACAGCACCAAG<br>TGTCTATCCACTGGCCCCTGTGTGTGGAGATAC<br>AACTGGCTCCTCGGTGACTCTAGGATGCCTGGT<br>CAAGGGTTATTTCCCTGAGCCAGTGACCTTGAC<br>CTGGAACTCTGGATCCCTGTCCAGTGGTGTGCA<br>CACCTTCCCAGCTGTCCTGCAGTCTGACCTCTA<br>CACCCTCAGCAGCTCAGTGACTGTAACCTCGA<br>GCACCTGGCCCAGCCAGTCCATCACCTGCAAT<br>GTGGCCCACCCGGCAAGCAGCACCAAGGTGGA<br>CAAGAAAATTGAGCCCAGAGGGCCCACAATCA<br>AGCCCTGTCCTCCATGCAAATGCCCAGCACCT<br>AACCTCTTGGGTGGACCATCCGTCTTCATCTTC<br>CCTCCAAAGATCAAGGATGTACTCATGATCTC<br>CCTGAGCCCCATAGTCACATGTGTGGTGGTGG<br>ATGTGAGCGAGGATGACCCAGATGTCCAGATC<br>AGCTGGTTTGTGAACAACGTGGAAGTACACAC<br>AGCTCAGACACAAACCCATAGAGAGGATTACA<br>ACAGTACTCTCCGGGTGGTCAGTGCCCTCCCCA<br>TCCAGCACCAGGACTGGATGAGTGGCAAGGAG<br>TTCAAATGCAAGGTCAACAACAAAGACCTCCC<br>AGCGCCCATCGAGAGAACCATCTCAAAACCCA<br>AAGGGTCAGTAAGAGCTCCACAGGTATATGTC<br>TTGCCTCCACCAGAAGAAGAGATGACTAAGAA<br>ACAGGTCACTCTGACCTGCATGGTCACAGACT<br>TCATGCCTGAAGACATTTACGTGGAGTGGACC<br>AACAACGGGAAAACAGAGCTAAACTACAAGA<br>ACACTGAACCAGTCCTGGACTCTGATGGTTCTT<br>ACTTCATGTACAGCAAGCTGAGAGTGGAAAAG<br>AAGAACTGGGTGGAAAGAAATAGCTACTCCTG<br>TTCAGTGGTCCACGAGGGTCTGCACAATCACC<br>ACACGACTAAGAGCTTCTCCCGGACTCCGGGT<br>AAA | 1137 |
| SM1B314 | pDR000029286 | CAGGTGCAGCTGAAGCAGAGCGGCCCTGGCCT<br>GGTGCAGCCTAGCCAGAGCCTGCCCATCACCT<br>GTACCGTGTCCGGCTTCAGCCTGACCACCTACG<br>GCCTGCACTGGATCCGGCAGAGCCCCGGCAAG<br>GGCCTGGAATGGCTGGGAGTGATTTGGAGAGG<br>CGGCACCACCGACTACAACGCCGCCTTCATGA<br>GCCGGCTGACCATCACCAAGGACAACAGCAAG | 1138 |

TABLE 46-continued

HlgA/LukE Antibody Heavy Chain CDSs

| Protein AA ID | Construct ID | Heavy ChainCDS | SEQ ID NO: |
|---|---|---|---|
| | | AGCCAGGTGTTCTTCAAGATGAACAGCCTGCA<br>GGCCGACGACACCGCCATCTACTACTGCGCCC<br>GGACCGACATCTGGGGCGCTGGCACCACCGTG<br>ACCGTGTCCTCTGCCAAAACAACAGCACCAAG<br>TGTCTATCCACTGGCCCTGTGTGTGGAGATAC<br>AACTGGCTCCTCGGTGACTCTAGGATGCCTGGT<br>CAAGGGTTATTTCCCTGAGCCAGTGACCTTGAC<br>CTGGAACTCTGGATCCCTGTCCAGTGGTGTGCA<br>CACCTTCCCAGCTGTCCTGCAGTCTGACCTCTA<br>CACCCTCAGCAGCTCAGTGACTGTAACCTCGA<br>GCACCTGGCCCAGCCAGTCCATCACCTGCAAT<br>GTGGCCCACCCGGCAAGCAGCACCAAGGTGGA<br>CAAGAAAATTGAGCCCAGAGGGCCCACAATCA<br>AGCCCTGTCCTCCATGCAAATGCCCAGCACCT<br>AACCTCTTGGGTGGACCATCCGTCTTCATCTTC<br>CCTCCAAAGATCAAGGATGTACTCATGATCTC<br>CCTGAGCCCCATAGTCACATGTGTGGTGGTGG<br>ATGTGAGCGAGGATGACCCAGATGTCCAGATC<br>AGCTGGTTTGTGAACAACGTGGAAGTACACAC<br>AGCTCAGACACAAACCCATAGAGAGGATTACA<br>ACAGTACTCTCCGGGTGGTCAGTGCCCTCCCCA<br>TCCAGCACCAGGACTGGATGAGTGGCAAGGAG<br>TTCAAATGCAAGGTCAACAACAAAGACCTCCC<br>AGCGCCCATCGAGAGAACCATCTCAAAACCCA<br>AAGGGTCAGTAAGAGCTCCACAGGTATATGTC<br>TTGCCTCCACCAGAAGAAGAGATGACTAAGAA<br>ACAGGTCACTCTGACCTGCATGGTCACAGACT<br>TCATGCCTGAAGACATTTACGTGGAGTGGACC<br>AACAACGGGAAAACAGAGCTAAACTACAAGA<br>ACACTGAACCAGTCCTGGACTCTGATGGTTCTT<br>ACTTCATGTACAGCAAGCTGAGAGTGGAAAAG<br>AAGAACTGGGTGGAAAGAAATAGCTACTCCTG<br>TTCAGTGGTCCACGAGGGTCTGCACAATCACC<br>ACACGACTAAGAGCTTCTCCCGGACTCCGGGT<br>AAA | |
| SM1B315 | pDR000029285 | CAGGTGCAGCTGAAGCAGAGCGGCCCTGGCCT<br>GGTGCAGCCTAGCCAGAGCCTGAGCATCACCT<br>GTACCGTGTCCGGCTTCAGCCTGACCACCTACG<br>GCCTGCACTGGATCCGGCAGAGCCCCGGCAAG<br>GGCCTGGAATGGCTGGGAGTGATTTGGAGAGG<br>CGGCACCACCGACTACAACGCCGCCTTCATGA<br>GCCGGCTGACCATCACCAAGGACAACAGCAAG<br>AGCCAGGTGTTCTTCAAGATGAACAGCCTGCA<br>GGCCGACGACACCGCCATCTACTACTGCGCCC<br>GGACCGACATCTGGGGCGCTGGCACCACCGTG<br>ACCGTGTCCTCTGCCAAAACAACAGCACCAAG<br>TGTCTATCCACTGGCCCTGTGTGTGGAGATAC<br>AACTGGCTCCTCGGTGACTCTAGGATGCCTGGT<br>CAAGGGTTATTTCCCTGAGCCAGTGACCTTGAC<br>CTGGAACTCTGGATCCCTGTCCAGTGGTGTGCA<br>CACCTTCCCAGCTGTCCTGCAGTCTGACCTCTA<br>CACCCTCAGCAGCTCAGTGACTGTAACCTCGA<br>GCACCTGGCCCAGCCAGTCCATCACCTGCAAT<br>GTGGCCCACCCGGCAAGCAGCACCAAGGTGGA<br>CAAGAAAATTGAGCCCAGAGGGCCCACAATCA<br>AGCCCTGTCCTCCATGCAAATGCCCAGCACCT<br>AACCTCTTGGGTGGACCATCCGTCTTCATCTTC<br>CCTCCAAAGATCAAGGATGTACTCATGATCTC<br>CCTGAGCCCCATAGTCACATGTGTGGTGGTGG<br>ATGTGAGCGAGGATGACCCAGATGTCCAGATC<br>AGCTGGTTTGTGAACAACGTGGAAGTACACAC<br>AGCTCAGACACAAACCCATAGAGAGGATTACA<br>ACAGTACTCTCCGGGTGGTCAGTGCCCTCCCCA<br>TCCAGCACCAGGACTGGATGAGTGGCAAGGAG<br>TTCAAATGCAAGGTCAACAACAAAGACCTCCC<br>AGCGCCCATCGAGAGAACCATCTCAAAACCCA<br>AAGGGTCAGTAAGAGCTCCACAGGTATATGTC<br>TTGCCTCCACCAGAAGAAGAGATGACTAAGAA<br>ACAGGTCACTCTGACCTGCATGGTCACAGACT<br>TCATGCCTGAAGACATTTACGTGGAGTGGACC<br>AACAACGGGAAAACAGAGCTAAACTACAAGA<br>ACACTGAACCAGTCCTGGACTCTGATGGTTCTT<br>ACTTCATGTACAGCAAGCTGAGAGTGGAAAAG<br>AAGAACTGGGTGGAAAGAAATAGCTACTCCTG | 1139 |

TABLE 46-continued

HlgA/LukE Antibody Heavy Chain CDSs

| Protein AA ID | Construct ID | Heavy ChainCDS | SEQ ID NO: |
|---|---|---|---|
| | | TTCAGTGGTCCACGAGGGTCTGCACAATCACC ACACGACTAAGAGCTTCTCCCGGACTCCGGGT AAA | |
| SM1B316 | pDR000029287 | CAGGTGCAGCTGAAGCAGAGCGGCCCTAGCCT GGTGCAGCCCAGCCAGAGCCTGAGCATCACCT GTACCGTGTCCGGCTTCAGCCTGACCACCTACG GCCTGCACTGGATCCGGCAGAGCCCCGGCAAG GGCCTGGAATGGCTGGGAGTGATTTGGAGAGG CGGCACCACCGACTACAACGCCGCCTTCATGA GCCGGCTGACCATCACCAAGGACAACAGCAAG AGCCAGGTGTTCTTCAAGATGAACAGCCTGCA GGCCGACGACACCGCCATCTACTACTGCGCCC GGACCGACATCTGGGGCGCTGGCACCACCGTG ACCGTGTCCTCTGCCAAAACAACAGCACCAAG TGTCTATCCACTGGCCCCTGTGTGTGGAGATAC AACTGGCTCCTCGGTGACTCTAGGATGCCTGGT CAAGGGTTATTTCCCTGAGCCAGTGACCTTGAC CTGGAACTCTGGATCCCTGTCCAGTGGTGTGCA CACCTTCCCAGCTGTCCTGCAGTCTGACCTCTA CACCCTCAGCAGCTCAGTGACTGTAACCTCGA GCACCTGGCCCAGCCAGTCCATCACCTGCAAT GTGGCCCACCCGGCAAGCAGCACCAAGGTGGA CAAGAAAATTGAGCCCAGAGGGCCCACAATCA AGCCCTGTCCTCCATGCAAATGCCCAGCACCT AACCTCTTGGGTGGACCATCCGTCTTCATCTTC CCTCCAAAGATCAAGGATGTACTCATGATCTC CCTGAGCCCCATAGTCACATGTGTGGTGGTGG ATGTGAGCGAGGATGACCCAGATGTCCAGATC AGCTGGTTTGTGAACAACGTGGAAGTACACAC AGCTCAGACACAAACCCATAGAGAGGATTACA ACAGTACTCTCCGGGTGGTCAGTGCCCTCCCCA TCCAGCACCAGGACTGGATGAGTGGCAAGGAG TTCAAATGCAAGGTCAACAACAAAGACCTCCC AGCGCCCATCGAGAGAACCATCTCAAAACCCA AAGGGTCAGTAAGAGCTCCACAGGTATATGTC TTGCCTCCACCAGAAGAAGAGATGACTAAGAA ACAGGTCACTCTGACCTGCATGGTCACAGACT TCATGCCTGAAGACATTTACGTGGAGTGGACC AACAACGGGAAAACAGAGCTAAACTACAAGA ACACTGAACCAGTCCTGGACTCTGATGGTTCTT ACTTCATGTACAGCAAGCTGAGAGTGGAAAAG AAGAACTGGGTGGAAAGAAATAGCTACTCCTG TTCAGTGGTCCACGAGGGTCTGCACAATCACC ACACGACTAAGAGCTTCTCCCGGACTCCGGGT AAA | 1140 |
| SM1B317 | pDR000029284 | CAGGTGCAGCTGAAGCAGAGCGGCCCTGGCCT GGTGCAGCCTAGCCAGAGCCTGAGCATCACCT GTACCGTGTCCGGCTTCAGCCTGACCAGCTAC GGCGTGCACTGGGTCCGACAGCCTCCCGGCAA GGGCCTGGAATGGCTGGGAGTGATTTGGAGCG GCGGCATCACCGACTACAACGCCGCCTTCATC AGCAGACTGAGCATCAGCAAGGACAACAGCA AGAGCCAGGTGTTCTTCAAGATGAACAGCCTG CAGGCCGACGACACCGCCATCTACTACTGCGC CAGAACCGACCTGTGGGGCCAGGGCACCCTGG TCACAGTGTCTGCCGCCAAAACAACAGCACCA AGTGTCTATCCACTGGCCCCTGTGTGTGGAGAT ACAACTGGCTCCTCGGTGACTCTAGGATGCCT GGTCAAGGGTTATTTCCCTGAGCCAGTGACCTT GACCTGGAACTCTGGATCCCTGTCCAGTGGTGT GCACACCTTCCCAGCTGTCCTGCAGTCTGACCT CTACACCCTCAGCAGCTCAGTGACTGTAACCTC GAGCACCTGGCCCAGCCAGTCCATCACCTGCA ATGTGGCCCACCCGGCAAGCAGCACCAAGGTG GACAAGAAAATTGAGCCCAGAGGGCCCACAAT CAAGCCCTGTCCTCCATGCAAATGCCCAGCAC CTAACCTCTTGGGTGGACCATCCGTCTTCATCT TCCCTCCAAAGATCAAGGATGTACTCATGATCT CCCTGAGCCCCATAGTCACATGTGTGGTGGTG GATGTGAGCGAGGATGACCCAGATGTCCAGAT CAGCTGGTTTGTGAACAACGTGGAAGTACACA CAGCTCAGACACAAACCCATAGAGAGGATTAC AACAGTACTCTCCGGGTGGTCAGTGCCCTCCCC | 1141 |

TABLE 46-continued

HlgA/LukE Antibody Heavy Chain CDSs

| Protein AA ID | Construct ID | Heavy ChainCDS | SEQ ID NO: |
|---|---|---|---|
| | | ATCCAGCACCAGGACTGGATGAGTGGCAAGGA<br>GTTCAAATGCAAGGTCAACAACAAAGACCTCC<br>CAGCGCCCATCGAGAGAACCATCTCAAAACCC<br>AAAGGGTCAGTAAGAGCTCCACAGGTATATGT<br>CTTGCCTCCACCAGAAGAAGAGATGACTAAGA<br>AACAGGTCACTCTGACCTGCATGGTCACAGAC<br>TTCATGCCTGAAGACATTTACGTGGAGTGGAC<br>CAACAACGGGAAAACAGAGCTAAACTACAAG<br>AACACTGAACCAGTCCTGGACTCTGATGGTTCT<br>TACTTCATGTACAGCAAGCTGAGAGTGGAAAA<br>GAAGAACTGGGTGGAAAGAAATAGCTACTCCT<br>GTTCAGTGGTCCACGAGGGTCTGCACAATCAC<br>CACACGACTAAGAGCTTCTCCCGGACTCCGGG<br>TAAA | |
| SM1B318 | pDR000029283 | CAGGTGCAGCTGCAGCAGTCTGGCGCCGAGCT<br>GATGAACCCTGGCGCCAGCGTGAAGATCAGCT<br>GCAAGAGCACCGGCTACAAGTTCAGCAGCTAC<br>TGGATCGAGTGGGTCAAGCAGCGGCCTGGCCA<br>CGGCCTGGAATGGATGGGCGAGATCCTGCCTG<br>GCAGCGGCAGCACCAACCACAACGAGAAGTTC<br>AAGGGCAAGGCCATCTTCACCGCCGACGCCAG<br>CAGCAACACCGCCTACATGGAACTGAGCAGCC<br>TGACCAGCGAGGACAGCGCCGTGTACTACTGC<br>GCCCGGACCATCAGCACCGCCACCGATTGGTT<br>CGCCTACTGGGGCCAGGGCACCCTGGTCACCG<br>TGTCTGCTGCCAAAACAACAGCACCAAGTGTC<br>TATCCACTGGCCCCTGTGTGTGGAGATACAACT<br>GGCTCCTCGGTGACTCTAGGATGCCTGGTCAA<br>GGGTTATTTCCCTGAGCCAGTGACCTTGACCTG<br>GAACTCTGGATCCCTGTCCAGTGGTGTGCACA<br>CCTTCCCAGCTGTCCTGCAGTCTGACCTCTACA<br>CCCTCAGCAGCTCAGTGACTGTAACCTCGAGC<br>ACCTGGCCCAGCCAGTCCATCACCTGCAATGT<br>GGCCCACCCGGCAAGCAGCACCAAGGTGGACA<br>AGAAAATTGAGCCCAGAGGGCCCACAATCAAG<br>CCCTGTCCTCCATGCAAATGCCCAGCACCTAAC<br>CTCTTGGGTGGACCATCCGTCTTCATCTTCCCT<br>CCAAAGATCAAGGATGTACTCATGATCTCCCT<br>GAGCCCCATAGTCACATGTGTGGTGGTGGATG<br>TGAGCGAGGATGACCCAGATGTCCAGATCAGC<br>TGGTTTGTGAACAACGTGGAAGTACACACAGC<br>TCAGACACAAACCCATAGAGAGGATTACAACA<br>GTACTCTCCGGGTGGTCAGTGCCCTCCCCATCC<br>AGCACCAGGACTGGATGAGTGGCAAGGAGTTC<br>AAATGCAAGGTCAACAACAAAGACCTCCCAGC<br>GCCCATCGAGAGAACCATCTCAAAACCCAAAG<br>GGTCAGTAAGAGCTCCACAGGTATATGTCTTG<br>CCTCCACCAGAAGAAGAGATGACTAAGAAACA<br>GGTCACTCTGACCTGCATGGTCACAGACTTCAT<br>GCCTGAAGACATTTACGTGGAGTGGACCAACA<br>ACGGGAAAACAGAGCTAAACTACAAGAACAC<br>TGAACCAGTCCTGGACTCTGATGGTTCTTACTT<br>CATGTACAGCAAGCTGAGAGTGGAAAAGAAG<br>AACTGGGTGGAAAGAAATAGCTACTCCTGTTC<br>AGTGGTCCACGAGGGTCTGCACAATCACCACA<br>CGACTAAGAGCTTCTCCCGGACTCCGGGTAAA | 1142 |
| SM1B319 | pDR000029283 | CAGGTGCAGCTGCAGCAGTCTGGCGCCGAGCT<br>GATGAACCCTGGCGCCAGCGTGAAGATCAGCT<br>GCAAGAGCACCGGCTACAAGTTCAGCAGCTAC<br>TGGATCGAGTGGGTCAAGCAGCGGCCTGGCCA<br>CGGCCTGGAATGGATGGGCGAGATCCTGCCTG<br>GCAGCGGCAGCACCAACCACAACGAGAAGTTC<br>AAGGGCAAGGCCATCTTCACCGCCGACGCCAG<br>CAGCAACACCGCCTACATGGAACTGAGCAGCC<br>TGACCAGCGAGGACAGCGCCGTGTACTACTGC<br>GCCCGGACCATCAGCACCGCCACCGATTGGTT<br>CGCCTACTGGGGCCAGGGCACCCTGGTCACCG<br>TGTCTGCTGCCAAAACAACAGCACCAAGTGTC<br>TATCCACTGGCCCCTGTGTGTGGAGATACAACT<br>GGCTCCTCGGTGACTCTAGGATGCCTGGTCAA<br>GGGTTATTTCCCTGAGCCAGTGACCTTGACCTG<br>GAACTCTGGATCCCTGTCCAGTGGTGTGCACA<br>CCTTCCCAGCTGTCCTGCAGTCTGACCTCTACA | 1143 |

TABLE 46-continued

HlgA/LukE Antibody Heavy Chain CDSs

| Protein AA ID | Construct ID | Heavy ChainCDS | SEQ ID NO: |
|---|---|---|---|
| | | CCCTCAGCAGCTCAGTGACTGTAACCTCGAGC<br>ACCTGGCCCAGCCAGTCCATCACCTGCAATGT<br>GGCCCACCCGGCAAGCAGCACCAAGGTGGACA<br>AGAAAATTGAGCCCAGAGGGCCCACAATCAAG<br>CCCTGTCCTCCATGCAAATGCCCAGCACCTAAC<br>CTCTTGGGTGGACCATCCGTCTTCATCTTCCCT<br>CCAAAGATCAAGGATGTACTCATGATCTCCCT<br>GAGCCCCATAGTCACATGTGTGGTGGTGGATG<br>TGAGCGAGGATGACCCAGATGTCCAGATCAGC<br>TGGTTTGTGAACAACGTGGAAGTACACACAGC<br>TCAGACACAAACCCATAGAGAGGATTACAACA<br>GTACTCTCCGGGTGGTCAGTGCCCTCCCCATCC<br>AGCACCAGGACTGGATGAGTGGCAAGGAGTTC<br>AAATGCAAGGTCAACAACAAAGACCTCCCAGC<br>GCCCATCGAGAGAACCATCTCAAAACCCAAAG<br>GGTCAGTAAGAGCTCCACAGGTATATGTCTTG<br>CCTCCACCAGAAGAAGAGATGACTAAGAAACA<br>GGTCACTCTGACCTGCATGGTCACAGACTTCAT<br>GCCTGAAGACATTTACGTGGAGTGGACCAACA<br>ACGGGAAAACAGAGCTAAACTACAAGAACAC<br>TGAACCAGTCCTGGACTCTGATGGTTCTTACTT<br>CATGTACAGCAAGCTGAGAGTGGAAAAGAAG<br>AACTGGGTGGAAAGAAATAGCTACTCCTGTTC<br>AGTGGTCCACGAGGGTCTGCACAATCACCACA<br>CGACTAAGAGCTTCTCCCGGACTCCGGGTAAA | |
| SM1B320 | pDR000029282 | CAGGTGCAGCTGCAGCAGTCTGGCGCCGAGCT<br>GATGAAGCCTGGCGCCAGCGTGAAGATGAGCT<br>GCAAGGCCACCGGCTACAAGTTCAGCAGCTAC<br>TGGATCGAGTGGGTCAAGCAGCGGCCTGGCCA<br>CGGCCTGGAATGGATGGGCGAGATCCTGCCTG<br>GCAGCGGCAGCACCAACCACAACGAGAAGTTC<br>AAGGGCAAGGCCATCTTCACCGCCGACGCCAG<br>CAGCAACACCGCCTACATGGAACTGAGCAGCC<br>TGACCAGCGAGGACAGCGCCGTGTACTACTGC<br>GCCCGGACCATCAGCACCGCCACCGATTGGTT<br>CGCCTACTGGGGCCAGGGCACCCTGGTCACCG<br>TGTCTGCTGCCAAAACAACAGCACCAAGTGTC<br>TATCCACTGGCCCCTGTGTGTGGAGATACAACT<br>GGCTCCTCGGTGACTCTAGGATGCCTGGTCAA<br>GGGTTATTTCCCTGAGCCAGTGACCTTGACCTG<br>GAACTCTGGATCCCTGTCCAGTGGTGTGCACA<br>CCTTCCCAGCTGTCCTGCAGTCTGACCTCTACA<br>CCCTCAGCAGCTCAGTGACTGTAACCTCGAGC<br>ACCTGGCCCAGCCAGTCCATCACCTGCAATGT<br>GGCCCACCCGGCAAGCAGCACCAAGGTGGACA<br>AGAAAATTGAGCCCAGAGGGCCCACAATCAAG<br>CCCTGTCCTCCATGCAAATGCCCAGCACCTAAC<br>CTCTTGGGTGGACCATCCGTCTTCATCTTCCCT<br>CCAAAGATCAAGGATGTACTCATGATCTCCCT<br>GAGCCCCATAGTCACATGTGTGGTGGTGGATG<br>TGAGCGAGGATGACCCAGATGTCCAGATCAGC<br>TGGTTTGTGAACAACGTGGAAGTACACACAGC<br>TCAGACACAAACCCATAGAGAGGATTACAACA<br>GTACTCTCCGGGTGGTCAGTGCCCTCCCCATCC<br>AGCACCAGGACTGGATGAGTGGCAAGGAGTTC<br>AAATGCAAGGTCAACAACAAAGACCTCCCAGC<br>GCCCATCGAGAGAACCATCTCAAAACCCAAAG<br>GGTCAGTAAGAGCTCCACAGGTATATGTCTTG<br>CCTCCACCAGAAGAAGAGATGACTAAGAAACA<br>GGTCACTCTGACCTGCATGGTCACAGACTTCAT<br>GCCTGAAGACATTTACGTGGAGTGGACCAACA<br>ACGGGAAAACAGAGCTAAACTACAAGAACAC<br>TGAACCAGTCCTGGACTCTGATGGTTCTTACTT<br>CATGTACAGCAAGCTGAGAGTGGAAAAGAAG<br>AACTGGGTGGAAAGAAATAGCTACTCCTGTTC<br>AGTGGTCCACGAGGGTCTGCACAATCACCACA<br>CGACTAAGAGCTTCTCCCGGACTCCGGGTAAA | 1144 |
| SM1B321 | pDR000029281 | CAGGTGCAGCTGCAGCAGTCTGGCGCCGAGCT<br>GATGAAGCCTGGCGCCAGCGTGAAGATGAGCT<br>GCAAGGCCACCGGCTACAAGTTCAGCAGCTAC<br>TGGATCGAGTGGGTCAAGCAGCGGCCTGGCCA<br>CGGCCTGGAATGGATGGGCGAGATCCTGCCTG<br>GCAGCGGCAGCACCAACCACAACGAGAAGTTC | 1145 |

TABLE 46-continued

HlgA/LukE Antibody Heavy Chain CDSs

| Protein AA ID | Construct ID | Heavy ChainCDS | SEQ ID NO: |
|---|---|---|---|
| | | ACCGGCAGAGCCATCTTCACCGCCGACGCCAG CAGCAACACCGCCTACATGGAACTGAGCAGCC TGACCAGCGAGGACAGCGCCGTGTACTACTGC GCCCGGACCATCAGCACCGCCACCGATTGGTT CGCCTACTGGGGCCAGGGCACCCTGGTCACCG TGTCTGCTGCCAAAACAACAGCACCAAGTGTC TATCCACTGGCCCCTGTGTGTGGAGATACAACT GGCTCCTCGGTGACTCTAGGATGCCTGGTCAA GGGTTATTTCCCTGAGCCAGTGACCTTGACCTG GAACTCTGGATCCCTGTCCAGTGGTGTGCACA CCTTCCCAGCTGTCCTGCAGTCTGACCTCTACA CCCTCAGCAGCTCAGTGACTGTAACCTCGAGC ACCTGGCCCAGCCAGTCCATCACCTGCAATGT GGCCCACCCGGCAAGCAGCACCAAGGTGGACA AGAAAATTGAGCCCAGAGGGCCCACAATCAAG CCCTGTCCTCCATGCAAATGCCCAGCACCTAAC CTCTTGGGTGGACCATCCGTCTTCATCTTCCCT CCAAAGATCAAGGATGTACTCATGATCTCCCT GAGCCCCATAGTCACATGTGTGGTGGTGGATG TGAGCGAGGATGACCCAGATGTCCAGATCAGC TGGTTTGTGAACAACGTGGAAGTACACACAGC TCAGACACAAACCCATAGAGAGGATTACAACA GTACTCTCCGGGTGGTCAGTGCCCTCCCCATCC AGCACCAGGACTGGATGAGTGGCAAGGAGTTC AAATGCAAGGTCAACAACAAAGACCTCCCAGC GCCCATCGAGAGAACCATCTCAAAACCCAAAG GGTCAGTAAGAGCTCCACAGGTATATGTCTTG CCTCCACCAGAAGAAGAGATGACTAAGAAACA GGTCACTCTGACCTGCATGGTCACAGACTTCAT GCCTGAAGACATTTACGTGGAGTGGACCAACA ACGGGAAAACAGAGCTAAACTACAAGAACAC TGAACCAGTCCTGGACTCTGATGGTTCTTACTT CATGTACAGCAAGCTGAGAGTGGAAAAGAAG AACTGGGTGGAAAGAAATAGCTACTCCTGTTC AGTGGTCCACGAGGGTCTGCACAATCACCACA CGACTAAGAGCTTCTCCCGGACTCCGGGTAAA | |
| SM1B322 | pDR000029282 | CAGGTGCAGCTGCAGCAGTCTGGCGCCGAGCT GATGAAGCCTGGCGCAGCGTGAAGATGAGCT GCAAGGCCACCGGCTACAAGTTCAGCAGCTAC TGGATCGAGTGGGTCAAGCAGCGGCCTGGCCA CGGCCTGGAATGGATGGGCGAGATCCTGCCTG GCAGCGGCAGCACCAACCACAACGAGAAGTTC AAGGGCAAGGCCATCTTCACCGCCGACGCCAG CAGCAACACCGCCTACATGGAACTGAGCAGCC TGACCAGCGAGGACAGCGCCGTGTACTACTGC GCCCGGACCATCAGCACCGCCACCGATTGGTT CGCCTACTGGGGCCAGGGCACCCTGGTCACCG TGTCTGCTGCCAAAACAACAGCACCAAGTGTC TATCCACTGGCCCCTGTGTGTGGAGATACAACT GGCTCCTCGGTGACTCTAGGATGCCTGGTCAA GGGTTATTTCCCTGAGCCAGTGACCTTGACCTG GAACTCTGGATCCCTGTCCAGTGGTGTGCACA CCTTCCCAGCTGTCCTGCAGTCTGACCTCTACA CCCTCAGCAGCTCAGTGACTGTAACCTCGAGC ACCTGGCCCAGCCAGTCCATCACCTGCAATGT GGCCCACCCGGCAAGCAGCACCAAGGTGGACA AGAAAATTGAGCCCAGAGGGCCCACAATCAAG CCCTGTCCTCCATGCAAATGCCCAGCACCTAAC CTCTTGGGTGGACCATCCGTCTTCATCTTCCCT CCAAAGATCAAGGATGTACTCATGATCTCCCT GAGCCCCATAGTCACATGTGTGGTGGTGGATG TGAGCGAGGATGACCCAGATGTCCAGATCAGC TGGTTTGTGAACAACGTGGAAGTACACACAGC TCAGACACAAACCCATAGAGAGGATTACAACA GTACTCTCCGGGTGGTCAGTGCCCTCCCCATCC AGCACCAGGACTGGATGAGTGGCAAGGAGTTC AAATGCAAGGTCAACAACAAAGACCTCCCAGC GCCCATCGAGAGAACCATCTCAAAACCCAAAG GGTCAGTAAGAGCTCCACAGGTATATGTCTTG CCTCCACCAGAAGAAGAGATGACTAAGAAACA GGTCACTCTGACCTGCATGGTCACAGACTTCAT GCCTGAAGACATTTACGTGGAGTGGACCAACA ACGGGAAAACAGAGCTAAACTACAAGAACAC TGAACCAGTCCTGGACTCTGATGGTTCTTACTT | 1146 |

TABLE 46-continued

HlgA/LukE Antibody Heavy Chain CDSs

| Protein AA ID | Construct ID | Heavy ChainCDS | SEQ ID NO: |
|---|---|---|---|
| | | CATGTACAGCAAGCTGAGAGTGGAAAAGAAG AACTGGGTGGAAAGAAATAGCTACTCCTGTTC AGTGGTCCACGAGGGTCTGCACAATCACCACA CGACTAAGAGCTTCTCCCGGACTCCGGGTAAA | |
| SM1B323 | pDR000029280 | CAGGTGCAGCTGCAGCAGTCTGGCGCCGAGCT GATGAAGCCTGGCGCCAGCGTGAAGATGCCCT GCAAGGCCACCGGCTACAAGTTCAGCAGCTAC TGGATCGAGTGGGTCAAGCAGCGGCCTGGCCA CGGCCTGGAATGGATGGGCGAGATCCTGCCTG GCAGCGGCAGCACCAACCACAACGAGAAGTTC AAGGGCAAGGCCATCTTCACCGCCGACGCCAG CAGCAACACCGCCTACATGGAACTGAGCAGCC TGACCAGCGAGGACAGCGCCGTGTACTACTGC GCCCGGACCATCAGCACCGCCACCGATTGGTT CGCCTACTGGGGCCAGGGCACCCTGGTCACCG TGTCTGCTGCCAAAACAACAGCACCAAGTGTC TATCCACTGGCCCCTGTGTGTGGAGATACAACT GGCTCCTCGGTGACTCTAGGATGCCTGGTCAA GGGTTATTTCCCTGAGCCAGTGACCTTGACCTG GAACTCTGGATCCCTGTCCAGTGGTGTGCACA CCTTCCCAGCTGTCCTGCAGTCTGACCTCTACA CCCTCAGCAGCTCAGTGACTGTAACCTCGAGC ACCTGGCCCAGCCAGTCCATCACCTGCAATGT GGCCCACCCGGCAAGCAGCACCAAGGTGGACA AGAAAATTGAGCCCAGAGGGCCCACAATCAAG CCCTGTCCTCCATGCAAATGCCCAGCACCTAAC CTCTTGGGTGGACCATCCGTCTTCATCTTCCCT CCAAAGATCAAGGATGTACTCATGATCTCCCT GAGCCCCATAGTCACATGTGTGGTGGTGGATG TGAGCGAGGATGACCCAGATGTCCAGATCAGC TGGTTTGTGAACAACGTGGAAGTACACACAGC TCAGACACAAACCCATAGAGAGGATTACAACA GTACTCTCCGGGTGGTCAGTGCCCTCCCCATCC AGCACCAGGACTGGATGAGTGGCAAGGAGTTC AAATGCAAGGTCAACAACAAAGACCTCCCAGC GCCCATCGAGAGAACCATCTCAAAACCCAAAG GGTCAGTAAGAGCTCCACAGGTATATGTCTTG CCTCCACCAGAAGAAGAGATGACTAAGAAACA GGTCACTCTGACCTGCATGGTCACAGACTTCAT GCCTGAAGACATTTACGTGGAGTGGACCAACA ACGGGAAAACAGAGCTAAACTACAAGAACAC TGAACCAGTCCTGGACTCTGATGGTTCTTACTT CATGTACAGCAAGCTGAGAGTGGAAAAGAAG AACTGGGTGGAAAGAAATAGCTACTCCTGTTC AGTGGTCCACGAGGGTCTGCACAATCACCACA CGACTAAGAGCTTCTCCCGGACTCCGGGTAAA | 1147 |
| SM1B324 | pDR000029279 | GAGGTGCAGCTGCAGCAGTCTGGCGCTGAACT CGTGCGGCCTGGCGCCCTGGTCAAGCTGAGCT GCAAGGCCAGCGGCTTCAACATCAAGGACTAC TACATGCACTGGGTCAAGCAGCGGCCCGAGCA GGGCCTGGAATGGATCGGCTGGATCGACCCCG AGAACGGCAACACCATCTACGACCCCAAGTTC CAGGGCAAGGCCTCCATCACCGCCGACACCAG CAGCAACACCGCCTACCTGCAGCTGAGCAGCC TGACCAGCGAGGACACCGCCGTGTACTACTGC GCCAGATACGACGGCTACGCCATGGACTACTG GGGCCAGGGCACCAGCGTGACCGTGTCCTCTG CCAAAACAACAGCACCAAGTGTCTATCCACTG GCCCCTGTGTGTGGAGATACAACTGGCTCCTC GGTGACTCTAGGATGCCTGGTCAAGGGTTATTT CCCTGAGCCAGTGACCTTGACCTGGAACTCTG GATCCCTGTCCAGTGGTGTGCACACCTTCCCAG CTGTCCTGCAGTCTGACCTCTACACCCTCAGCA GCTCAGTGACTGTAACCTCGAGCACCTGGCCC AGCCAGTCCATCACCTGCAATGTGGCCCACCC GGCAAGCAGCACCAAGGTGGACAAGAAAATT GAGCCCAGAGGGCCCACAATCAAGCCCTGTCC TCCATGCAAATGCCCAGCACCTAACCTCTTGG GTGGACCATCCGTCTTCATCTTCCCTCCAAAGA TCAAGGATGTACTCATGATCTCCCTGAGCCCCA TAGTCACATGTGTGGTGGTGGATGTGAGCGAG GATGACCCAGATGTCCAGATCAGCTGGTTTGT GAACAACGTGGAAGTACACACAGCTCAGACAC | 1148 |

TABLE 46-continued

HlgA/LukE Antibody Heavy Chain CDSs

| Protein AA ID | Construct ID | Heavy ChainCDS | SEQ ID NO: |
|---|---|---|---|
| | | AAACCCATAGAGAGGATTACAACAGTACTCTC CGGGTGGTCAGTGCCCTCCCCATCCAGCACCA GGACTGGATGAGTGGCAAGGAGTTCAAATGCA AGGTCAACAACAAAGACCTCCCAGCGCCCATC GAGAGAACCATCTCAAAACCCAAAGGGTCAGT AAGAGCTCCACAGGTATATGTCTTGCCTCCACC AGAAGAAGAGATGACTAAGAAACAGGTCACT CTGACCTGCATGGTCACAGACTTCATGCCTGA AGACATTTACGTGGAGTGGACCAACAACGGGA AAACAGAGCTAAACTACAAGAACACTGAACCA GTCCTGGACTCTGATGGTTCTTACTTCATGTAC AGCAAGCTGAGAGTGGAAAAGAAGAACTGGG TGGAAAGAAATAGCTACTCCTGTTCAGTGGTC CACGAGGGTCTGCACAATCACCACACGACTAA GAGCTTCTCCCGGACTCCGGGTAAA | |
| SM1B325 | pDR000029278 | CAGGTGCAGCTGCAGCAGTCTGGCGCTGAACT CGTGCGGCCTGGCACCAGCGTGAAGATGAGCT GCAAGGCCGCTGGCTACACCTTCACCAACTAC TGGATCGGCTGGGTCAAGCAGCGGCCTGGCCA CGGCCTGGAATGGATCGGCGACATCTACCCTG GCGGCGGATACACCAACTACAACGAGAAGTTC AAGGACAAGACCACCCTGACCGCCGACACCAG CAGCAACACCGCCTACATGCAGCTGAGCAGCC TGACCAGCGAGGACAGCGCCATCTACTACTGC GCCAGCAACGACTGCTGGGGCCAGGGCACCAC ACTGACCGTGTCCAGCGCCAAAACAACAGCAC CAAGTGTCTATCCACTGGCCCCTGTGTGTGGAG ATACAACTGGCTCCTCGGTGACTCTAGGATGC CTGGTCAAGGGTTATTTCCCTGAGCCAGTGACC TTGACCTGGAACTCTGGATCCCTGTCCAGTGGT GTGCACACCTTCCCAGCTGTCCTGCAGTCTGAC CTCTACACCCTCAGCAGCTCAGTGACTGTAACC TCGAGCACCTGGCCCAGCCAGTCCATCACCTG CAATGTGGCCCACCCGGCAAGCAGCACCAAGG TGGACAAGAAAATTGAGCCCAGAGGGCCCACA ATCAAGCCCTGTCCTCCATGCAAATGCCCAGC ACCTAACCTCTTGGGTGGACCATCCGTCTTCAT CTTCCCTCCAAAGATCAAGGATGTACTCATGAT CTCCCTGAGCCCCATAGTCACATGTGTGGTGGT GGATGTGAGCGAGGATGACCCAGATGTCCAGA TCAGCTGGTTTGTGAACAACGTGGAAGTACAC ACAGCTCAGACACAAACCCATAGAGAGGATTA CAACAGTACTCTCCGGGTGGTCAGTGCCCTCCC CATCCAGCACCAGGACTGGATGAGTGGCAAGG AGTTCAAATGCAAGGTCAACAACAAAGACCTC CCAGCGCCCATCGAGAGAACCATCTCAAAACC CAAAGGGTCAGTAAGAGCTCCACAGGTATATG TCTTGCCTCCACCAGAAGAAGAGATGACTAAG AAACAGGTCACTCTGACCTGCATGGTCACAGA CTTCATGCCTGAAGACATTTACGTGGAGTGGA CCAACAACGGGAAAACAGAGCTAAACTACAA GAACACTGAACCAGTCCTGGACTCTGATGGTT CTTACTTCATGTACAGCAAGCTGAGAGTGGAA AAGAAGAACTGGGTGGAAAGAAATAGCTACTC CTGTTCAGTGGTCCACGAGGGTCTGCACAATC ACCACACGACTAAGAGCTTCTCCCGGACTCCG GGTAAA | 1149 |
| SM1B326 | pDR000029277 | CAGGTGCAGCTGAAGCAGAGCGGCCCTGGCCT GGTGCAGCCTAGCCAGAGCCTGAGCATCACCT GTACCGTGTCCGGCTTCAGCATCACCAGCTAC GGCGTGCACTGGATCCGGCAGAGCCCCGGCAA GGGCCTGGAATGGCTGGGAGTGATTTGGAGCG GCGGCAGCACCGACTACAACGCCGCCTTCATC AGCAGACTGAGCATCAGCGAGGACAACAGCA AGAGCCAGGTGTTCTTCAAGATGAACAGCCTG CAGGCCAACGACACCGCCATCTACTACTGCGC CACCTTCTACTACGACTACGACGAGGGCTTCG ACTACTGGGGCCAGGGCACCACCCTGACCGTG TCCTCTGCCAAAACAACAGCACCAAGTGTCTA TCCACTGGCCCCTGTGTGTGGAGATACAACTG GCTCCTCGGTGACTCTAGGATGCCTGGTCAAG GGTTATTTCCCTGAGCCAGTGACCTTGACCTGG AACTCTGGATCCCTGTCCAGTGGTGTGCACACC | 1150 |

TABLE 46-continued

HlqA/LukE Antibody Heavy Chain CDSs

| Protein AA ID | Construct ID | Heavy ChainCDS | SEQ ID NO: |
|---|---|---|---|
| | | TTCCCAGCTGTCCTGCAGTCTGACCTCTACACC<br>CTCAGCAGCTCAGTGACTGTAACCTCGAGCAC<br>CTGGCCCAGCCAGTCCATCACCTGCAATGTGG<br>CCCACCCGGCAAGCAGCACCAAGGTGGACAAG<br>AAAATTGAGCCCAGAGGGCCCACAATCAAGCC<br>CTGTCCTCCATGCAAATGCCCAGCACCTAACCT<br>CTTGGGTGGACCATCCGTCTTCATCTTCCCTCC<br>AAAGATCAAGGATGTACTCATGATCTCCCTGA<br>GCCCCATAGTCACATGTGTGGTGGTGGATGTG<br>AGCGAGGATGACCCAGATGTCCAGATCAGCTG<br>GTTTGTGAACAACGTGGAAGTACACACAGCTC<br>AGACACAAACCCATAGAGAGGATTACAACAGT<br>ACTCTCCGGGTGGTCAGTGCCCTCCCCATCCAG<br>CACCAGGACTGGATGAGTGGCAAGGAGTTCAA<br>ATGCAAGGTCAACAACAAAGACCTCCCAGCGC<br>CCATCGAGAGAACCATCTCAAAACCCAAAGGG<br>TCAGTAAGAGCTCCACAGGTATATGTCTTGCCT<br>CCACCAGAAGAAGAGATGACTAAGAAACAGG<br>TCACTCTGACCTGCATGGTCACAGACTTCATGC<br>CTGAAGACATTTACGTGGAGTGGACCAACAAC<br>GGGAAAACAGAGCTAAACTACAAGAACACTG<br>AACCAGTCCTGGACTCTGATGGTTCTTACTTCA<br>TGTACAGCAAGCTGAGAGTGGAAAAGAAGAA<br>CTGGGTGGAAAGAAATAGCTACTCCTGTTCAG<br>TGGTCCACGAGGGTCTGCACAATCACCACACG<br>ACTAAGAGCTTCTCCCGGACTCCGGGTAAA | |
| SM1B327 | pDR000029276 | CAGGTGCAGCTGAAGCAGAGCGGCCCTGGCCT<br>GGTGCAGCCTAGCCAGAGCCTGAGCATCACCT<br>GTACCGTGTCCGGCTTCAGCATCACCAGCTAC<br>GGCGTGCACTGGATCCGGCAGAGCCCCGGCAA<br>GGGCCTGGAATGGCTGGGAGTGATTTGGAGCG<br>GCGGCAGCACCGACTACAACGCCGCCTTCATC<br>AGCAGACTGAGCATCAGCAAGGACAACAGCA<br>AGAGCCAGGTGTTCTTCAAGATGAACAGCCTG<br>CAGGCCAACGACACCGCCATCTACTACTGCGC<br>CACCTTCTACTACGACTACGACGAGGGCTTCG<br>ACTACTGGGGCCAGGGCACCACCCTGACCGTG<br>TCCTCTGCCAAAACAACAGCACCAAGTGTCTA<br>TCCACTGGCCCCTGTGTGTGGAGATACAACTG<br>GCTCCTCGGTGACTCTAGGATGCCTGGTCAAG<br>GGTTATTTCCCTGAGCCAGTGACCTTGACCTGG<br>AACTCTGGATCCCTGTCCAGTGGTGTGCACACC<br>TTCCCAGCTGTCCTGCAGTCTGACCTCTACACC<br>CTCAGCAGCTCAGTGACTGTAACCTCGAGCAC<br>CTGGCCCAGCCAGTCCATCACCTGCAATGTGG<br>CCCACCCGGCAAGCAGCACCAAGGTGGACAAG<br>AAAATTGAGCCCAGAGGGCCCACAATCAAGCC<br>CTGTCCTCCATGCAAATGCCCAGCACCTAACCT<br>CTTGGGTGGACCATCCGTCTTCATCTTCCCTCC<br>AAAGATCAAGGATGTACTCATGATCTCCCTGA<br>GCCCCATAGTCACATGTGTGGTGGTGGATGTG<br>AGCGAGGATGACCCAGATGTCCAGATCAGCTG<br>GTTTGTGAACAACGTGGAAGTACACACAGCTC<br>AGACACAAACCCATAGAGAGGATTACAACAGT<br>ACTCTCCGGGTGGTCAGTGCCCTCCCCATCCAG<br>CACCAGGACTGGATGAGTGGCAAGGAGTTCAA<br>ATGCAAGGTCAACAACAAAGACCTCCCAGCGC<br>CCATCGAGAGAACCATCTCAAAACCCAAAGGG<br>TCAGTAAGAGCTCCACAGGTATATGTCTTGCCT<br>CCACCAGAAGAAGAGATGACTAAGAAACAGG<br>TCACTCTGACCTGCATGGTCACAGACTTCATGC<br>CTGAAGACATTTACGTGGAGTGGACCAACAAC<br>GGGAAAACAGAGCTAAACTACAAGAACACTG<br>AACCAGTCCTGGACTCTGATGGTTCTTACTTCA<br>TGTACAGCAAGCTGAGAGTGGAAAAGAAGAA<br>CTGGGTGGAAAGAAATAGCTACTCCTGTTCAG<br>TGGTCCACGAGGGTCTGCACAATCACCACACG<br>ACTAAGAGCTTCTCCCGGACTCCGGGTAAA | 1151 |
| SM1B328 | pDR000029276 | CAGGTGCAGCTGAAGCAGAGCGGCCCTGGCCT<br>GGTGCAGCCTAGCCAGAGCCTGAGCATCACCT<br>GTACCGTGTCCGGCTTCAGCATCACCAGCTAC<br>GGCGTGCACTGGATCCGGCAGAGCCCCGGCAA<br>GGGCCTGGAATGGCTGGGAGTGATTTGGAGCG | 1152 |

TABLE 46-continued

HlgA/LukE Antibody Heavy Chain CDSs

| Protein AA ID | Construct ID | Heavy ChainCDS | SEQ ID NO: |
|---|---|---|---|
| | | GCGGCAGCACCGACTACAACGCCGCCTTCATC<br>AGCAGACTGAGCATCAGCAAGGACAACAGCA<br>AGAGCCAGGTGTTCTTCAAGATGAACAGCCTG<br>CAGGCCAACGACACCGCCATCTACTACTGCGC<br>CACCTTCTACTACGACTACGACGAGGGCTTCG<br>ACTACTGGGGCCAGGGCACCACCCTGACCGTG<br>TCCTCTGCCAAAACAACAGCACCAAGTGTCTA<br>TCCACTGGCCCCTGTGTGTGGAGATACAACTG<br>GCTCCTCGGTGACTCTAGGATGCCTGGTCAAG<br>GGTTATTTCCCTGAGCCAGTGACCTTGACCTGG<br>AACTCTGGATCCCTGTCCAGTGGTGTGCACACC<br>TTCCCAGCTGTCCTGCAGTCTGACCTCTACACC<br>CTCAGCAGCTCAGTGACTGTAACCTCGAGCAC<br>CTGGCCCAGCCAGTCCATCACCTGCAATGTGG<br>CCCACCCGGCAAGCAGCACCAAGGTGGACAAG<br>AAAATTGAGCCCAGAGGGCCCACAATCAAGCC<br>CTGTCCTCCATGCAAATGCCCAGCACCTAACCT<br>CTTGGGTGGACCATCCGTCTTCATCTTCCCTCC<br>AAAGATCAAGGATGTACTCATGATCTCCCTGA<br>GCCCCATAGTCACATGTGTGGTGGTGGATGTG<br>AGCGAGGATGACCCAGATGTCCAGATCAGCTG<br>GTTTGTGAACAACGTGGAAGTACACACAGCTC<br>AGACACAAACCCATAGAGAGGATTACAACAGT<br>ACTCTCCGGGTGGTCAGTGCCCTCCCCATCCAG<br>CACCAGGACTGGATGAGTGGCAAGGAGTTCAA<br>ATGCAAGGTCAACAACAAAGACCTCCCAGCGC<br>CCATCGAGAGAACCATCTCAAAACCCAAAGGG<br>TCAGTAAGAGCTCCACAGGTATATGTCTTGCCT<br>CCACCAGAAGAAGAGATGACTAAGAAACAGG<br>TCACTCTGACCTGCATGGTCACAGACTTCATGC<br>CTGAAGACATTTACGTGGAGTGGACCAACAAC<br>GGGAAAACAGAGCTAAACTACAAGAACACTG<br>AACCAGTCCTGGACTCTGATGGTTCTTACTTCA<br>TGTACAGCAAGCTGAGAGTGGAAAAGAAGAA<br>CTGGGTGGAAAGAAATAGCTACTCCTGTTCAG<br>TGGTCCACGAGGGTCTGCACAATCACCACACG<br>ACTAAGAGCTTCTCCCGGACTCCGGGTAAA | |
| SM1B329 | pDR000029276 | CAGGTGCAGCTGAAGCAGAGCGGCCCTGGCCT<br>GGTGCAGCCTAGCCAGAGCCTGAGCATCACCT<br>GTACCGTGTCCGGCTTCAGCATCACCAGCTAC<br>GGCGTGCACTGGATCCGGCAGAGCCCCGGCAA<br>GGGCCTGGAATGGCTGGGAGTGATTTGGAGCG<br>GCGGCAGCACCGACTACAACGCCGCCTTCATC<br>AGCAGACTGAGCATCAGCAAGGACAACAGCA<br>AGAGCCAGGTGTTCTTCAAGATGAACAGCCTG<br>CAGGCCAACGACACCGCCATCTACTACTGCGC<br>CACCTTCTACTACGACTACGACGAGGGCTTCG<br>ACTACTGGGGCCAGGGCACCACCCTGACCGTG<br>TCCTCTGCCAAAACAACAGCACCAAGTGTCTA<br>TCCACTGGCCCCTGTGTGTGGAGATACAACTG<br>GCTCCTCGGTGACTCTAGGATGCCTGGTCAAG<br>GGTTATTTCCCTGAGCCAGTGACCTTGACCTGG<br>AACTCTGGATCCCTGTCCAGTGGTGTGCACACC<br>TTCCCAGCTGTCCTGCAGTCTGACCTCTACACC<br>CTCAGCAGCTCAGTGACTGTAACCTCGAGCAC<br>CTGGCCCAGCCAGTCCATCACCTGCAATGTGG<br>CCCACCCGGCAAGCAGCACCAAGGTGGACAAG<br>AAAATTGAGCCCAGAGGGCCCACAATCAAGCC<br>CTGTCCTCCATGCAAATGCCCAGCACCTAACCT<br>CTTGGGTGGACCATCCGTCTTCATCTTCCCTCC<br>AAAGATCAAGGATGTACTCATGATCTCCCTGA<br>GCCCCATAGTCACATGTGTGGTGGTGGATGTG<br>AGCGAGGATGACCCAGATGTCCAGATCAGCTG<br>GTTTGTGAACAACGTGGAAGTACACACAGCTC<br>AGACACAAACCCATAGAGAGGATTACAACAGT<br>ACTCTCCGGGTGGTCAGTGCCCTCCCCATCCAG<br>CACCAGGACTGGATGAGTGGCAAGGAGTTCAA<br>ATGCAAGGTCAACAACAAAGACCTCCCAGCGC<br>CCATCGAGAGAACCATCTCAAAACCCAAAGGG<br>TCAGTAAGAGCTCCACAGGTATATGTCTTGCCT<br>CCACCAGAAGAAGAGATGACTAAGAAACAGG<br>TCACTCTGACCTGCATGGTCACAGACTTCATGC<br>CTGAAGACATTTACGTGGAGTGGACCAACAAC<br>GGGAAAACAGAGCTAAACTACAAGAACACTG | 1153 |

TABLE 46-continued

HlgA/LukE Antibody Heavy Chain CDSs

| Protein AA ID | Construct ID | Heavy ChainCDS | SEQ ID NO: |
|---|---|---|---|
| | | AACCAGTCCTGGACTCTGATGGTTCTTACTTCA<br>TGTACAGCAAGCTGAGAGTGGAAAAGAAGAA<br>CTGGGTGGAAAGAAATAGCTACTCCTGTTCAG<br>TGGTCCACGAGGGTCTGCACAATCACCACACG<br>ACTAAGAGCTTCTCCCGGACTCCGGGTAAA | |
| SM1B330 | pDR000029276 | CAGGTGCAGCTGAAGCAGAGCGGCCCTGGCCT<br>GGTGCAGCCTAGCCAGAGCCTGAGCATCACCT<br>GTACCGTGTCCGGCTTCAGCATCACCAGCTAC<br>GGCGTGCACTGGATCCGGCAGAGCCCCGGCAA<br>GGGCCTGGAATGGCTGGGAGTGATTTGGAGCG<br>GCGGCAGCACCGACTACAACGCCGCCTTCATC<br>AGCAGACTGAGCATCAGCAAGGACAACAGCA<br>AGAGCCAGGTGTTCTTCAAGATGAACAGCCTG<br>CAGGCCAACGACACCGCCATCTACTACTGCGC<br>CACCTTCTACTACGACTACGACGAGGGCTTCG<br>ACTACTGGGGCCAGGGCACCACCCTGACCGTG<br>TCCTCTGCCAAAACAACAGCACCAAGTGTCTA<br>TCCACTGGCCCCTGTGTGTGGAGATACAACTG<br>GCTCCTCGGTGACTCTAGGATGCCTGGTCAAG<br>GGTTATTTCCCTGAGCCAGTGACCTTGACCTGG<br>AACTCTGGATCCCTGTCCAGTGGTGTGCACACC<br>TTCCCAGCTGTCCTGCAGTCTGACCTCTACACC<br>CTCAGCAGCTCAGTGACTGTAACCTCGAGCAC<br>CTGGCCCAGCCAGTCCATCACCTGCAATGTGG<br>CCCACCCGGCAAGCAGCACCAAGGTGGACAAG<br>AAAATTGAGCCCAGAGGGCCCACAATCAAGCC<br>CTGTCCTCCATGCAAATGCCCAGCACCTAACCT<br>CTTGGGTGGACCATCCGTCTTCATCTTCCCTCC<br>AAAGATCAAGGATGTACTCATGATCTCCCTGA<br>GCCCCATAGTCACATGTGTGGTGGTGGATGTG<br>AGCGAGGATGACCCAGATGTCCAGATCAGCTG<br>GTTTGTGAACAACGTGGAAGTACACACAGCTC<br>AGACACAAACCCATAGAGAGGATTACAACAGT<br>ACTCTCCGGGTGGTCAGTGCCCTCCCCATCCAG<br>CACCAGGACTGGATGAGTGGCAAGGAGTTCAA<br>ATGCAAGGTCAACAACAAAGACCTCCCAGCGC<br>CCATCGAGAGAACCATCTCAAAACCCAAAGGG<br>TCAGTAAGAGCTCCACAGGTATATGTCTTGCCT<br>CCACCAGAAGAAGAGATGACTAAGAAACAGG<br>TCACTCTGACCTGCATGGTCACAGACTTCATGC<br>CTGAAGACATTTACGTGGAGTGGACCAACAAC<br>GGGAAAACAGAGCTAAACTACAAGAACACTG<br>AACCAGTCCTGGACTCTGATGGTTCTTACTTCA<br>TGTACAGCAAGCTGAGAGTGGAAAAGAAGAA<br>CTGGGTGGAAAGAAATAGCTACTCCTGTTCAG<br>TGGTCCACGAGGGTCTGCACAATCACCACACG<br>ACTAAGAGCTTCTCCCGGACTCCGGGTAAA | 1154 |
| SM1B331 | pDR000029276 | CAGGTGCAGCTGAAGCAGAGCGGCCCTGGCCT<br>GGTGCAGCCTAGCCAGAGCCTGAGCATCACCT<br>GTACCGTGTCCGGCTTCAGCATCACCAGCTAC<br>GGCGTGCACTGGATCCGGCAGAGCCCCGGCAA<br>GGGCCTGGAATGGCTGGGAGTGATTTGGAGCG<br>GCGGCAGCACCGACTACAACGCCGCCTTCATC<br>AGCAGACTGAGCATCAGCAAGGACAACAGCA<br>AGAGCCAGGTGTTCTTCAAGATGAACAGCCTG<br>CAGGCCAACGACACCGCCATCTACTACTGCGC<br>CACCTTCTACTACGACTACGACGAGGGCTTCG<br>ACTACTGGGGCCAGGGCACCACCCTGACCGTG<br>TCCTCTGCCAAAACAACAGCACCAAGTGTCTA<br>TCCACTGGCCCCTGTGTGTGGAGATACAACTG<br>GCTCCTCGGTGACTCTAGGATGCCTGGTCAAG<br>GGTTATTTCCCTGAGCCAGTGACCTTGACCTGG<br>AACTCTGGATCCCTGTCCAGTGGTGTGCACACC<br>TTCCCAGCTGTCCTGCAGTCTGACCTCTACACC<br>CTCAGCAGCTCAGTGACTGTAACCTCGAGCAC<br>CTGGCCCAGCCAGTCCATCACCTGCAATGTGG<br>CCCACCCGGCAAGCAGCACCAAGGTGGACAAG<br>AAAATTGAGCCCAGAGGGCCCACAATCAAGCC<br>CTGTCCTCCATGCAAATGCCCAGCACCTAACCT<br>CTTGGGTGGACCATCCGTCTTCATCTTCCCTCC<br>AAAGATCAAGGATGTACTCATGATCTCCCTGA<br>GCCCCATAGTCACATGTGTGGTGGTGGATGTG<br>AGCGAGGATGACCCAGATGTCCAGATCAGCTG | 1155 |

TABLE 46-continued

HlgA/LukE Antibody Heavy Chain CDSs

| Protein AA ID | Construct ID | Heavy ChainCDS | SEQ ID NO: |
|---|---|---|---|
| | | GTTTGTGAACAACGTGGAAGTACACACAGCTC AGACACAAACCCATAGAGAGGATTACAACAGT ACTCTCCGGGTGGTCAGTGCCCTCCCCATCCAG CACCAGGACTGGATGAGTGGCAAGGAGTTCAA ATGCAAGGTCAACAACAAAGACCTCCCAGCGC CCATCGAGAGAACCATCTCAAAACCCAAAGGG TCAGTAAGAGCTCCACAGGTATATGTCTTGCCT CCACCAGAAGAAGAGATGACTAAGAAACAGG TCACTCTGACCTGCATGGTCACAGACTTCATGC CTGAAGACATTTACGTGGAGTGGACCAACAAC GGGAAAACAGAGCTAAACTACAAGAACACTG AACCAGTCCTGGACTCTGATGGTTCTTACTTCA TGTACAGCAAGCTGAGAGTGGAAAAGAAGAA CTGGGTGGAAAGAAATAGCTACTCCTGTTCAG TGGTCCACGAGGGTCTGCACAATCACCACACG ACTAAGAGCTTCTCCCGGACTCCGGGTAAA | |
| SM1B332 | pDR000029275 | CAGGTGCAGCTGAAAGAGTCCGGCCCTGGACT GGTGGCCCCCAGCCAGAGCCTGAGCATCACCT GTACCGTGTCCGGCCTGAGCCTGACCAGCTAC GGCCTGTCTTGGGTCCGACAGCCCCCTGGCAA GGGCCTGGAATGGCTGGGAGTGATCTGGGGCG ACGGCAGCACCAACTACCACAGCGCCCTGATC AGCAGACTGAGCATCAGCAAGGACAACAGCA AGAGCCAGGTGTTCCTGAAGCTGAACAGCCTG CAGAGCGACGACACCGCCACCTACTACTGCGC CACCAGAGGCGACTACGGCAGCTACGCCATGG ACTACTGGGGCCAGGGCACCAGCGTGACCGTG TCCTCTGCCAAAACAACAGCACCAAGTGTCTA TCCACTGGCCCCTGTGTGTGGAGATACAACTG GCTCCTCGGTGACTCTAGGATGCCTGGTCAAG GGTTATTTCCCTGAGCCAGTGACCTTGACCTGG AACTCTGGATCCCTGTCCAGTGGTGTGCACACC TTCCCAGCTGTCCTGCAGTCTGACCTCTACACC CTCAGCAGCTCAGTGACTGTAACCTCGAGCAC CTGGCCCAGCCAGTCCATCACCTGCAATGTGG CCCACCCGGCAAGCAGCACCAAGGTGGACAAG AAAATTGAGCCCAGAGGGCCCACAATCAAGCC CTGTCCTCCATGCAAATGCCCAGCACCTAACCT CTTGGGTGGACCATCCGTCTTCATCTTCCCTCC AAAGATCAAGGATGTACTCATGATCTCCCTGA GCCCCATAGTCACATGTGTGGTGGTGGATGTG AGCGAGGATGACCCAGATGTCCAGATCAGCTG GTTTGTGAACAACGTGGAAGTACACACAGCTC AGACACAAACCCATAGAGAGGATTACAACAGT ACTCTCCGGGTGGTCAGTGCCCTCCCCATCCAG CACCAGGACTGGATGAGTGGCAAGGAGTTCAA ATGCAAGGTCAACAACAAAGACCTCCCAGCGC CCATCGAGAGAACCATCTCAAAACCCAAAGGG TCAGTAAGAGCTCCACAGGTATATGTCTTGCCT CCACCAGAAGAAGAGATGACTAAGAAACAGG TCACTCTGACCTGCATGGTCACAGACTTCATGC CTGAAGACATTTACGTGGAGTGGACCAACAAC GGGAAAACAGAGCTAAACTACAAGAACACTG AACCAGTCCTGGACTCTGATGGTTCTTACTTCA TGTACAGCAAGCTGAGAGTGGAAAAGAAGAA CTGGGTGGAAAGAAATAGCTACTCCTGTTCAG TGGTCCACGAGGGTCTGCACAATCACCACACG ACTAAGAGCTTCTCCCGGACTCCGGGTAAA | 1156 |
| SM1B333 | pDR000029274 | GAGGTGCAGCTGCAGCAGTCTGGCGCTGAACT CGTGCGGCCTGGCGCCAGCGTGAAGCTGAGCT GTACCGCCAGCGGCTTCAACATCAAGGACAGC CTGATCCACTGGGTCAAGCAGCGGCCCGAGCA GGGCCTGGAATGGATCGGCTGGATCGACCCCG AGGACGGCGAGACTAAGTACGCCCCCAAGTTC CAGGACAAGGCCGCCCTGACCACCGACACCAG CAGCAACACCGCCTACCTGCACCTGAACAGCC TGACCAGCGAGGACACCGCCATCTACTACTGC GGCAGAGGCGGCCTGATCCTGGACTACTGGGG CCAGGGCACCACCCTGACCGTGTCCTCTGCCA AAACAACAGCACCAAGTGTCTATCCACTGGCC CCTGTGTGTGGAGATACAACTGGCTCCTCGGT GACTCTAGGATGCCTGGTCAAGGGTTATTTCCC TGAGCCAGTGACCTTGACCTGGAACTCTGGAT | 1157 |

TABLE 46-continued

HlgA/LukE Antibody Heavy Chain CDSs

| Protein AA ID | Construct ID | Heavy ChainCDS | SEQ ID NO: |
|---|---|---|---|
| | | CCCTGTCCAGTGGTGTGCACACCTTCCCAGCTG TCCTGCAGTCTGACCTCTACACCCTCAGCAGCT CAGTGACTGTAACCTCGAGCACCTGGCCCAGC CAGTCCATCACCTGCAATGTGGCCCACCCGGC AAGCAGCACCAAGGTGGACAAGAAAATTGAG CCCAGAGGGCCCACAATCAAGCCCTGTCCTCC ATGCAAATGCCCAGCACCTAACCTCTTGGGTG GACCATCCGTCTTCATCTTCCCTCCAAAGATCA AGGATGTACTCATGATCTCCCTGAGCCCCATA GTCACATGTGTGGTGGTGGATGTGAGCGAGGA TGACCCAGATGTCCAGATCAGCTGGTTTGTGA ACAACGTGGAAGTACACACAGCTCAGACACAA ACCCATAGAGAGGATTACAACAGTACTCTCCG GGTGGTCAGTGCCCTCCCCATCCAGCACCAGG ACTGGATGAGTGGCAAGGAGTTCAAATGCAAG GTCAACAACAAAGACCTCCCAGCGCCCATCGA GAGAACCATCTCAAAACCCAAAGGGTCAGTAA GAGCTCCACAGGTATATGTCTTGCCTCCACCAG AAGAAGAGATGACTAAGAAACAGGTCACTCTG ACCTGCATGGTCACAGACTTCATGCCTGAAGA CATTTACGTGGAGTGGACCAACAACGGGAAAA CAGAGCTAAACTACAAGAACACTGAACCAGTC CTGGACTCTGATGGTTCTTACTTCATGTACAGC AAGCTGAGAGTGGAAAAGAAGAACTGGGTGG AAAGAAATAGCTACTCCTGTTCAGTGGTCCAC GAGGGTCTGCACAATCACCACACGACTAAGAG CTTCTCCCGGACTCCGGGTAAA | |
| SM1B334 | pDR000029273 | CAGATCCAGCTGGTGCAGAGCGGCCCTGAGCT GAAGAAACCCGGCGAGACAGTGAAGATCAGC TGCAGAAGCAGCGGCTACACCTTCACCAACTA CGGCCTGAACTGGGTCAAGCAGGCCCCTGGCA AGGACCTGAAGTGGATGGGCTGGCTGAACACC TACACCGGCGAGCCCACCTACGCCGACGACTT CAAGGGCAGATTCGCCTTCAGCCTGGAAACCA GCGCCGGCACCGCCTACCTGCAGATCAACAAC CTGAAGAACGAGGACACCGCCACCTACTTTTG CTCCCGGGACTACCGCGAGGGCGACGCCATGG ATTACTGGTCCCAGGGCACCAGCGTGACCGTG TCCAGCGCCAAAACAACAGCACCAAGTGTCTA TCCACTGGCCCCTGTGTGTGGAGATACAACTG GCTCCTCGGTGACTCTAGGATGCCTGGTCAAG GGTTATTTCCCTGAGCCAGTGACCTTGACCTGG AACTCTGGATCCCTGTCCAGTGGTGTGCACACC TTCCCAGCTGTCCTGCAGTCTGACCTCTACACC CTCAGCAGCTCAGTGACTGTAACCTCGAGCAC CTGGCCCAGCCAGTCCATCACCTGCAATGTGG CCCACCCGGCAAGCAGCACCAAGGTGGACAAG AAAATTGAGCCCAGAGGGCCCACAATCAAGCC CTGTCCTCCATGCAAATGCCCAGCACCTAACCT CTTGGGTGGACCATCCGTCTTCATCTTCCCTCC AAAGATCAAGGATGTACTCATGATCTCCCTGA GCCCCATAGTCACATGTGTGGTGGTGGATGTG AGCGAGGATGACCCAGATGTCCAGATCAGCTG GTTTGTGAACAACGTGGAAGTACACACAGCTC AGACACAAACCCATAGAGAGGATTACAACAGT ACTCTCCGGGTGGTCAGTGCCCTCCCCATCCAG CACCAGGACTGGATGAGTGGCAAGGAGTTCAA ATGCAAGGTCAACAACAAAGACCTCCCAGCGC CCATCGAGAGAACCATCTCAAAACCCAAAGGG TCAGTAAGAGCTCCACAGGTATATGTCTTGCCT CCACCAGAAGAAGAGATGACTAAGAAACAGG TCACTCTGACCTGCATGGTCACAGACTTCATGC CTGAAGACATTTACGTGGAGTGGACCAACAAC GGGAAAACAGAGCTAAACTACAAGAACACTG AACCAGTCCTGGACTCTGATGGTTCTTACTTCA TGTACAGCAAGCTGAGAGTGGAAAAGAAGAA CTGGGTGGAAAGAAATAGCTACTCCTGTTCAG TGGTCCACGAGGGTCTGCACAATCACCACACG ACTAAGAGCTTCTCCCGGACTCCGGGTAAA | 1158 |
| SM1B335 | pDR000029272 | GAGGTGCAGCTGGTGGAAAGCGGCGGAGGAC TGGTCAAGCCTGGCGGCAGCCTGAAGCTGAGC TGCGCCGCCAGCGGCTTCACCTTCAGCAGCTA CGCCATGAGCTGGGTCCGACAGACCCCCGAGA | 1159 |

TABLE 46-continued

HlgA/LukE Antibody Heavy Chain CDSs

| Protein AA ID | Construct ID | Heavy ChainCDS | SEQ ID NO: |
|---|---|---|---|
| | | AGCGGCTGGAATGGGTGGCCACCATCAGCACC AGCGGCAGCTACACCTACTACCGGGACAGCGT GAAGGGCCGGCTGACCATCAGCCGGGACAACG CCAAGAACACCCTGTACCTGCAGATGACCAGC CTGCGGAGCGAGGACACCGCCATGTACTACTG CACCCGGCACGGCGACCACGACGGCTTCGATT ACTGGGGCCAGGGCACCACCCTGACCGTGTCC TCTGCCAAAACAACAGCACCAAGTGTCTATCC ACTGGCCCCTGTGTGTGGAGATACAACTGGCT CCTCGGTGACTCTAGGATGCCTGGTCAAGGGT TATTTCCCTGAGCCAGTGACCTTGACCTGGAAC TCTGGATCCCTGTCCAGTGGTGTGCACACCTTC CCAGCTGTCCTGCAGTCTGACCTCTACACCCTC AGCAGCTCAGTGACTGTAACCTCGAGCACCTG GCCCAGCCAGTCCATCACCTGCAATGTGGCCC ACCCGGCAAGCAGCACCAAGGTGGACAAGAA AATTGAGCCCAGAGGGCCCACAATCAAGCCCT GTCCTCCATGCAAATGCCCAGCACCTAACCTCT TGGGTGGACCATCCGTCTTCATCTTCCCTCCAA AGATCAAGGATGTACTCATGATCTCCCTGAGC CCCATAGTCACATGTGTGGTGGTGGATGTGAG CGAGGATGACCCAGATGTCCAGATCAGCTGGT TTGTGAACAACGTGGAAGTACACACAGCTCAG ACACAAACCCATAGAGAGGATTACAACAGTAC TCTCCGGGTGGTCAGTGCCCTCCCCATCCAGCA CCAGGACTGGATGAGTGGCAAGGAGTTCAAAT GCAAGGTCAACAACAAAGACCTCCCAGCGCCC ATCGAGAGAACCATCTCAAAACCCAAAGGGTC AGTAAGAGCTCCACAGGTATATGTCTTGCCTCC ACCAGAAGAAGAGATGACTAAGAAACAGGTC ACTCTGACCTGCATGGTCACAGACTTCATGCCT GAAGACATTTACGTGGAGTGGACCAACAACGG GAAAACAGAGCTAAACTACAAGAACACTGAA CCAGTCCTGGACTCTGATGGTTCTTACTTCATG TACAGCAAGCTGAGAGTGGAAAAGAAGAACT GGGTGGAAAGAAATAGCTACTCCTGTTCAGTG GTCCACGAGGGTCTGCACAATCACCACACGAC TAAGAGCTTCTCCCGGACTCCGGGTAAA | |
| SM1B336 | pDR000029271 | GAGGTGCAGCTGGTGGAAAGCGGCGGAGGAC TGGTCAAGCCTGGCGGCAGCCTGAAGCTGAGC TGCGTGGCCTCCGGCTTCAGCTTCAGCAACTAC GCCATGAGCTGGGTCCGACAGACCCCCGAGCG GAGACTGGAATGGGTGGCCACCATCAACAGCG GCGGCAGCTTCAGCTTTTTCCCAGACTCCGTGA AGGGCCGGTTCACCATCAGCCGGGACAGCGCC AAGAACACCCTGTACCTGCAGATGAGCAGCCT GCGGAGCGACGACACCGCCATGTACTACTGCA CCCGGCACTGGGACCACCCCTTGGTTTGCCTACT GGGGCCAGGGCACCCTGGTCACCGTGTCTGCT GCCAAAACAACAGCACCAAGTGTCTATCCACT GGCCCCTGTGTGTGGAGATACAACTGGCTCCT CGGTGACTCTAGGATGCCTGGTCAAGGGTTAT TTCCCTGAGCCAGTGACCTTGACCTGGAACTCT GGATCCCTGTCCAGTGGTGTGCACACCTTCCCA GCTGTCCTGCAGTCTGACCTCTACACCCTCAGC AGCTCAGTGACTGTAACCTCGAGCACCTGGCC CAGCCAGTCCATCACCTGCAATGTGGCCCACC CGGCAAGCAGCACCAAGGTGGACAAGAAAAT TGAGCCCAGAGGGCCCACAATCAAGCCCTGTC CTCCATGCAAATGCCCAGCACCTAACCTCTTGG GTGGACCATCCGTCTTCATCTTCCCTCCAAAGA TCAAGGATGTACTCATGATCTCCCTGAGCCCCA TAGTCACATGTGTGGTGGTGGATGTGAGCGAG GATGACCCAGATGTCCAGATCAGCTGGTTTGT GAACAACGTGGAAGTACACACAGCTCAGACAC AAACCCATAGAGAGGATTACAACAGTACTCTC CGGGTGGTCAGTGCCCTCCCCATCCAGCACCA GGACTGGATGAGTGGCAAGGAGTTCAAATGCA AGGTCAACAACAAAGACCTCCCAGCGCCCATC GAGAGAACCATCTCAAAACCCAAAGGGTCAGT AAGAGCTCCACAGGTATATGTCTTGCCTCCACC AGAAGAAGAGATGACTAAGAAACAGGTCACT CTGACCTGCATGGTCACAGACTTCATGCCTGA AGACATTTACGTGGAGTGGACCAACAACGGGA | 1160 |

TABLE 46-continued

HlgA/LukE Antibody Heavy Chain CDSs

| Protein AA ID | Construct ID | Heavy ChainCDS | SEQ ID NO: |
|---|---|---|---|
| | | AAACAGAGCTAAACTACAAGAACACTGAACCA<br>GTCCTGGACTCTGATGGTTCTTACTTCATGTAC<br>AGCAAGCTGAGAGTGGAAAAGAAGAACTGGG<br>TGGAAAGAAATAGCTACTCCTGTTCAGTGGTC<br>CACGAGGGTCTGCACAATCACCACACGACTAA<br>GAGCTTCTCCCGGACTCCGGGTAAA | |
| SM1B337 | pDR000029271 | GAGGTGCAGCTGGTGGAAAGCGGCGGAGGAC<br>TGGTCAAGCCTGGCGGCAGCCTGAAGCTGAGC<br>TGCGTGGCCTCCGGCTTCAGCTTCAGCAACTAC<br>GCCATGAGCTGGGTCCGACAGACCCCCGAGCG<br>GAGACTGGAATGGGTGGCCACCATCAACAGCG<br>GCGGCAGCTTCAGCTTTTTCCCAGACTCCGTGA<br>AGGGCCGGTTCACCATCAGCCGGGACAGCGCC<br>AAGAACACCCTGTACCTGCAGATGAGCAGCCT<br>GCGGAGCGACGACACCGCCATGTACTACTGCA<br>CCCGGCACTGGGACCACCCTTGGTTTGCCTACT<br>GGGGCCAGGGCACCCTGGTCACCGTGTCTGCT<br>GCCAAAACAACAGCACCAAGTGTCTATCCACT<br>GGCCCCTGTGTGTGGAGATACAACTGGCTCCT<br>CGGTGACTCTAGGATGCCTGGTCAAGGGTTAT<br>TTCCCTGAGCCAGTGACCTTGACCTGGAACTCT<br>GGATCCCTGTCCAGTGGTGTGCACACCTTCCCA<br>GCTGTCCTGCAGTCTGACCTCTACACCCTCAGC<br>AGCTCAGTGACTGTAACCTCGAGCACCTGGCC<br>CAGCCAGTCCATCACCTGCAATGTGGCCCACC<br>CGGCAAGCAGCACCAAGGTGGACAAGAAAAT<br>TGAGCCCAGAGGGCCCACAATCAAGCCCTGTC<br>CTCCATGCAAATGCCCAGCACCTAACCTCTTGG<br>GTGGACCATCCGTCTTCATCTTCCCTCCAAAGA<br>TCAAGGATGTACTCATGATCTCCCTGAGCCCCA<br>TAGTCACATGTGTGGTGGTGGATGTGAGCGAG<br>GATGACCCAGATGTCCAGATCAGCTGGTTTGT<br>GAACAACGTGGAAGTACACACAGCTCAGACAC<br>AAACCCATAGAGAGGATTACAACAGTACTCTC<br>CGGGTGGTCAGTGCCCTCCCCATCCAGCACCA<br>GGACTGGATGAGTGGCAAGGAGTTCAAATGCA<br>AGGTCAACAACAAAGACCTCCCAGCGCCCATC<br>GAGAGAACCATCTCAAAACCCAAAGGGTCAGT<br>AAGAGCTCCACAGGTATATGTCTTGCCTCCACC<br>AGAAGAAGAGATGACTAAGAAACAGGTCACT<br>CTGACCTGCATGGTCACAGACTTCATGCCTGA<br>AGACATTTACGTGGAGTGGACCAACAACGGGA<br>AAACAGAGCTAAACTACAAGAACACTGAACCA<br>GTCCTGGACTCTGATGGTTCTTACTTCATGTAC<br>AGCAAGCTGAGAGTGGAAAAGAAGAACTGGG<br>TGGAAAGAAATAGCTACTCCTGTTCAGTGGTC<br>CACGAGGGTCTGCACAATCACCACACGACTAA<br>GAGCTTCTCCCGGACTCCGGGTAAA | 1161 |
| SM1B338 | pDR000029271 | GAGGTGCAGCTGGTGGAAAGCGGCGGAGGAC<br>TGGTCAAGCCTGGCGGCAGCCTGAAGCTGAGC<br>TGCGTGGCCTCCGGCTTCAGCTTCAGCAACTAC<br>GCCATGAGCTGGGTCCGACAGACCCCCGAGCG<br>GAGACTGGAATGGGTGGCCACCATCAACAGCG<br>GCGGCAGCTTCAGCTTTTTCCCAGACTCCGTGA<br>AGGGCCGGTTCACCATCAGCCGGGACAGCGCC<br>AAGAACACCCTGTACCTGCAGATGAGCAGCCT<br>GCGGAGCGACGACACCGCCATGTACTACTGCA<br>CCCGGCACTGGGACCACCCTTGGTTTGCCTACT<br>GGGGCCAGGGCACCCTGGTCACCGTGTCTGCT<br>GCCAAAACAACAGCACCAAGTGTCTATCCACT<br>GGCCCCTGTGTGTGGAGATACAACTGGCTCCT<br>CGGTGACTCTAGGATGCCTGGTCAAGGGTTAT<br>TTCCCTGAGCCAGTGACCTTGACCTGGAACTCT<br>GGATCCCTGTCCAGTGGTGTGCACACCTTCCCA<br>GCTGTCCTGCAGTCTGACCTCTACACCCTCAGC<br>AGCTCAGTGACTGTAACCTCGAGCACCTGGCC<br>CAGCCAGTCCATCACCTGCAATGTGGCCCACC<br>CGGCAAGCAGCACCAAGGTGGACAAGAAAAT<br>TGAGCCCAGAGGGCCCACAATCAAGCCCTGTC<br>CTCCATGCAAATGCCCAGCACCTAACCTCTTGG<br>GTGGACCATCCGTCTTCATCTTCCCTCCAAAGA<br>TCAAGGATGTACTCATGATCTCCCTGAGCCCCA<br>TAGTCACATGTGTGGTGGTGGATGTGAGCGAG | 1162 |

TABLE 46-continued

HlgA/LukE Antibody Heavy Chain CDSs

| Protein AA ID | Construct ID | Heavy ChainCDS | SEQ ID NO: |
|---|---|---|---|
| | | GATGACCCAGATGTCCAGATCAGCTGGTTTGT<br>GAACAACGTGGAAGTACACACAGCTCAGACAC<br>AAACCCATAGAGAGGATTACAACAGTACTCTC<br>CGGGTGGTCAGTGCCCTCCCCATCCAGCACCA<br>GGACTGGATGAGTGGCAAGGAGTTCAAATGCA<br>AGGTCAACAACAAAGACCTCCCAGCGCCCATC<br>GAGAGAACCATCTCAAAACCCAAAGGGTCAGT<br>AAGAGCTCCACAGGTATATGTCTTGCCTCCACC<br>AGAAGAAGAGATGACTAAGAAACAGGTCACT<br>CTGACCTGCATGGTCACAGACTTCATGCCTGA<br>AGACATTTACGTGGAGTGGACCAACAACGGGA<br>AAACAGAGCTAAACTACAAGAACACTGAACCA<br>GTCCTGGACTCTGATGGTTCTTACTTCATGTAC<br>AGCAAGCTGAGAGTGGAAAAGAAGAACTGGG<br>TGGAAAGAAATAGCTACTCCTGTTCAGTGGTC<br>CACGAGGGTCTGCACAATCACCACACGACTAA<br>GAGCTTCTCCCGGACTCCGGGTAAA | |
| SM1B339 | pDR000029270 | GAGGTGCAGCTGCAGCAGTCTGGCGCTGAACT<br>CGTGCGGCCTGGCGCCAGCGTGAAGCTGAGCT<br>GCACCACCAGCGGCTTCAACATCAAGGACAGC<br>CTGATCTACTGGGTCAAGCAGCGGCCCGAGCA<br>GGGCCTGGAATGGATCGGCTGGATCGACCCCG<br>AGGACGGCGAGACAAAGTTCGCCCCCAGATTC<br>CAGGACAAGGCCACCATCACCAGCGACACCAG<br>CAGCAACACCGCCTACCTGCGGCTGAGCAGCC<br>TGACCAGCAAGGACACCGCCATCTACTACTGC<br>ACCCGGTCCTTCGGCGTGTGCTGGGGCCAGGG<br>CACCCTGGTCACAGTGTCTGCCGCCAAAACAA<br>CAGCACCAAGTGTCTATCCACTGGCCCCTGTGT<br>GTGGAGATACAACTGGCTCCTCGGTGACTCTA<br>GGATGCCTGGTCAAGGGTTATTTCCCTGAGCC<br>AGTGACCTTGACCTGGAACTCTGGATCCCTGTC<br>CAGTGGTGTGCACACCTTCCCAGCTGTCCTGCA<br>GTCTGACCTCTACACCCTCAGCAGCTCAGTGAC<br>TGTAACCTCGAGCACCTGGCCCAGCCAGTCCA<br>TCACCTGCAATGTGGCCCACCCGGCAAGCAGC<br>ACCAAGGTGGACAAGAAAATTGAGCCCAGAG<br>GGCCCACAATCAAGCCCTGTCCTCCATGCAAA<br>TGCCCAGCACCTAACCTCTTGGGTGGACCATCC<br>GTCTTCATCTTCCCTCCAAAGATCAAGGATGTA<br>CTCATGATCTCCCTGAGCCCCATAGTCACATGT<br>GTGGTGGTGGATGTGAGCGAGGATGACCCAGA<br>TGTCCAGATCAGCTGGTTTGTGAACAACGTGG<br>AAGTACACACAGCTCAGACACAAACCCATAGA<br>GAGGATTACAACAGTACTCTCCGGGTGGTCAG<br>TGCCCTCCCCATCCAGCACCAGGACTGGATGA<br>GTGGCAAGGAGTTCAAATGCAAGGTCAACAAC<br>AAAGACCTCCCAGCGCCCATCGAGAGAACCAT<br>CTCAAAACCCAAAGGGTCAGTAAGAGCTCCAC<br>AGGTATATGTCTTGCCTCCACCAGAAGAAGAG<br>ATGACTAAGAAACAGGTCACTCTGACCTGCAT<br>GGTCACAGACTTCATGCCTGAAGACATTTACG<br>TGGAGTGGACCAACAACGGGAAAACAGAGCT<br>AAACTACAAGAACACTGAACCAGTCCTGGACT<br>CTGATGGTTCTTACTTCATGTACAGCAAGCTGA<br>GAGTGGAAAAGAAGAACTGGGTGGAAAGAAA<br>TAGCTACTCCTGTTCAGTGGTCCACGAGGGTCT<br>GCACAATCACCACACGACTAAGAGCTTCTCCC<br>GGACTCCGGGTAAA | 1163 |
| SM1B340 | pDR000029269 | GAGGTGCAGCTGCAGCAGTCTGGCGCTGAACT<br>CGTGCGGCCTGGCGCCAGCGTGAAGCTGAGCT<br>GCACCACCAGCGGCTTCAACATCAAGGACAGC<br>CTGATCTACTGGGTCAAGCAGCGGCCCGAGCA<br>GGGCCTGGAATGGATCGGCTGGATCGACCCCG<br>AGGACGGCGAGACAAAGTTCGCCCCCAGATTC<br>CAGGACAAGGCCACCATCACCAGCGACACCAG<br>CAGCAACACCGCCTACCTGCGGCTGAGCAGCC<br>TGACCAGCGAGGACACCGCCATCTACTACTGC<br>ACCCGGTCCTTCGGCGTGTGCTGGGGCCAGGG<br>CACCCTGGTCACAGTGTCTGCCGCCAAAACAA<br>CAGCACCAAGTGTCTATCCACTGGCCCCTGTGT<br>GTGGAGATACAACTGGCTCCTCGGTGACTCTA<br>GGATGCCTGGTCAAGGGTTATTTCCCTGAGCC | 1164 |

TABLE 46-continued

HlgA/LukE Antibody Heavy Chain CDSs

| Protein AA ID | Construct ID | Heavy ChainCDS | SEQ ID NO: |
|---|---|---|---|
| | | AGTGACCTTGACCTGGAACTCTGGATCCCTGTC<br>CAGTGGTGTGCACACCTTCCCAGCTGTCCTGCA<br>GTCTGACCTCTACACCCTCAGCAGCTCAGTGAC<br>TGTAACCTCGAGCACCTGGCCCAGCCAGTCCA<br>TCACCTGCAATGTGGCCCACCCGGCAAGCAGC<br>ACCAAGGTGGACAAGAAAATTGAGCCCAGAG<br>GGCCCACAATCAAGCCCTGTCCTCCATGCAAA<br>TGCCCAGCACCTAACCTCTTGGGTGGACCATCC<br>GTCTTCATCTTCCCTCCAAAGATCAAGGATGTA<br>CTCATGATCTCCCTGAGCCCCATAGTCACATGT<br>GTGGTGGTGGATGTGAGCGAGGATGACCCAGA<br>TGTCCAGATCAGCTGGTTTGTGAACAACGTGG<br>AAGTACACACAGCTCAGACACAAACCCATAGA<br>GAGGATTACAACAGTACTCTCCGGGTGGTCAG<br>TGCCCTCCCCATCCAGCACCAGGACTGGATGA<br>GTGGCAAGGAGTTCAAATGCAAGGTCAACAAC<br>AAAGACCTCCCAGCGCCCATCGAGAGAACCAT<br>CTCAAAACCCAAAGGGTCAGTAAGAGCTCCAC<br>AGGTATATGTCTTGCCTCCACCAGAAGAAGAG<br>ATGACTAAGAAACAGGTCACTCTGACCTGCAT<br>GGTCACAGACTTCATGCCTGAAGACATTTACG<br>TGGAGTGGACCAACAACGGGAAAACAGAGCT<br>AAACTACAAGAACACTGAACCAGTCCTGGACT<br>CTGATGGTTCTTACTTCATGTACAGCAAGCTGA<br>GAGTGGAAAAGAAGAACTGGGTGGAAAGAAA<br>TAGCTACTCCTGTTCAGTGGTCCACGAGGGTCT<br>GCACAATCACCACACGACTAAGAGCTTCTCCC<br>GGACTCCGGGTAAA | |

TABLE 47

HlgA/LukE Antibody Heavy Chain Primary Transcripts

| mAB/Fab name | Construct ID | Heavy Chain Primary Transcript | SEQ ID NO: |
|---|---|---|---|
| SM1B302 | pDR000029296 | ATGGCTTGGGTGTGGACCTTGCTATTCCTGATG<br>GCAGCTGCCCAAAGTATACAGGCCGAAGTGAA<br>GCTGGTGGAATCTGGCGGCGACCTGGTCAAGC<br>CTGGCGGCAGCCTGAAGCTGAGCTGCGCCGCC<br>AGCGGCTTCACCTTCAGCAGCTTCGCCATGAG<br>CTGGGTCCGACAGACCCCCGAGAAGCGGCTGG<br>AATGGGTGGCCAGCATCAGCCGGACCGACAAC<br>ACCTACTACCCCGACAGCATGAAGGGCCAGTT<br>CACCATCAGCCGGGACAACGCCCGGAACATCC<br>TGTACCTGCAGATGAGCAGCCTGCGGAGCGAG<br>AACACCGCCATCTACTACTGCGCCAGAGCCGA<br>CTACGACGGCCCTTGGTTTGCCTACTGGGGCCA<br>GGGCACCCTGGTCACCGTGTCTGCTGCCAAAA<br>CAACAGCACCAAGTGTCTATCCACTGGCCCCT<br>GTGTGTGGAGATACAACTGGCTCCTCGGTGAC<br>TCTAGGATGCCTGGTCAAGGGTTATTTCCCTGA<br>GCCAGTGACCTTGACCTGGAACTCTGGATCCCT<br>GTCCAGTGGTGTGCACACCTTCCCAGCTGTCCT<br>GCAGTCTGACCTCTACACCCTCAGCAGCTCAGT<br>GACTGTAACCTCGAGCACCTGGCCCAGCCAGT<br>CCATCACCTGCAATGTGGCCCACCCGGCAAGC<br>AGCACCAAGGTGGACAAGAAAATTGAGCCCA<br>GAGGGCCCACAATCAAGCCCTGTCCTCCATGC<br>AAATGCCCAGCACCTAACCTCTTGGGTGGACC<br>ATCCGTCTTCATCTTCCCTCCAAAGATCAAGGA<br>TGTACTCATGATCTCCCTGAGCCCCATAGTCAC<br>ATGTGTGGTGGTGGATGTGAGCGAGGATGACC<br>CAGATGTCCAGATCAGCTGGTTTGTGAACAAC<br>GTGGAAGTACACACAGCTCAGACACAAACCCA<br>TAGAGAGGATTACAACAGTACTCTCCGGGTGG<br>TCAGTGCCCTCCCCATCCAGCACCAGGACTGG<br>ATGAGTGGCAAGGAGTTCAAATGCAAGGTCAA<br>CAACAAAGACCTCCCAGCGCCCATCGAGAGAA<br>CCATCTCAAAACCCAAAGGGTCAGTAAGAGCT<br>CCACAGGTATATGTCTTGCCTCCACCAGAAGA<br>AGAGATGACTAAGAAACAGGTCACTCTGACCT | 1165 |

TABLE 47-continued

HlgA/LukE Antibody Heavy Chain Primary Transcripts

| mAB/Fab name | Construct ID | Heavy Chain Primary Transcript | SEQ ID NO: |
|---|---|---|---|
| | | GCATGGTCACAGACTTCATGCCTGAAGACATT<br>TACGTGGAGTGGACCAACAACGGGAAAACAG<br>AGCTAAACTACAAGAACACTGAACCAGTCCTG<br>GACTCTGATGGTTCTTACTTCATGTACAGCAAG<br>CTGAGAGTGGAAAAGAAGAACTGGGTGGAAA<br>GAAATAGCTACTCCTGTTCAGTGGTCCACGAG<br>GGTCTGCACAATCACCACACGACTAAGAGCTT<br>CTCCCGGACTCCGGGTAAATGA | |
| SM1B303 | pDR000029295 | ATGGCTTGGGTGTGGACCTTGCTATTCCTGATG<br>GCAGCTGCCCAAAGTATACAGGCCGAGGTGCA<br>GCTGCAGCAGAGCGGCCCTGATCTGGTCAAGC<br>CCGGCACCAGCGTGAAGATGAGCTGCAAGGCC<br>AGCGGCTACAGCTTCACCGGCTACTACATGCA<br>CTGGGTCAAGCAGAGCCACGGCAAGAGCCTGG<br>AATGGATCGGCAGAGTGAACCCCAACAACGGC<br>GGCACCAGCTACAACCAGAAGTTCAAGGGCAA<br>GGCCATCCTGACCGTGGACAAGAGCAGCAGCA<br>CCGCCTACATGGAACTGCGGAGCCTGACCAGC<br>GAGGACAGCGCCGTGTACTACTGCGCCAGGGA<br>CGACTACAGCTTCGCCTACTGGGGCCAGGGCA<br>CCCTGGTCACCGTGTCTGCTGCCAAAACAACA<br>GCACCAAGTGTCTATCCACTGGCCCCTGTGTGT<br>GGAGATACAACTGGCTCCTCGGTGACTCTAGG<br>ATGCCTGGTCAAGGGTTATTTCCCTGAGCCAGT<br>GACCTTGACCTGGAACTCTGGATCCCTGTCCAG<br>TGGTGTGCACACCTTCCCAGCTGTCCTGCAGTC<br>TGACCTCTACACCCTCAGCAGCTCAGTGACTGT<br>AACCTCGAGCACCTGGCCCAGCCAGTCCATCA<br>CCTGCAATGTGGCCCACCGGCAAGCAGCACC<br>AAGGTGGACAAGAAAATTGAGCCCAGAGGGC<br>CCACAATCAAGCCCTGTCCTCCATGCAAATGC<br>CCAGCACCTAACCTCTTGGGTGGACCATCCGTC<br>TTCATCTTCCCTCCAAAGATCAAGGATGTACTC<br>ATGATCTCCCTGAGCCCCATAGTCACATGTGTG<br>GTGGTGGATGTGAGCGAGGATGACCCAGATGT<br>CCAGATCAGCTGGTTTGTGAACAACGTGGAAG<br>TACACACAGCTCAGACACAAACCCATAGAGAG<br>GATTACAACAGTACTCTCCGGGTGGTCAGTGC<br>CCTCCCCATCCAGCACCAGGACTGGATGAGTG<br>GCAAGGAGTTCAAATGCAAGGTCAACAACAAA<br>GACCTCCCAGCGCCCATCGAGAGAACCATCTC<br>AAAACCCAAAGGGTCAGTAAGAGCTCCACAGG<br>TATATGTCTTGCCTCCACCAGAAGAAGAGATG<br>ACTAAGAAACAGGTCACTCTGACCTGCATGGT<br>CACAGACTTCATGCCTGAAGACATTTACGTGG<br>AGTGGACCAACAACGGGAAAACAGAGCTAAA<br>CTACAAGAACACTGAACCAGTCCTGGACTCTG<br>ATGGTTCTTACTTCATGTACAGCAAGCTGAGA<br>GTGGAAAAGAAGAACTGGGTGGAAAGAAATA<br>GCTACTCCTGTTCAGTGGTCCACGAGGGTCTGC<br>ACAATCACCACACGACTAAGAGCTTCTCCCGG<br>ACTCCGGGTAAATGA | 1166 |
| SM1B304 | pDR000029294 | ATGGCTTGGGTGTGGACCTTGCTATTCCTGATG<br>GCAGCTGCCCAAAGTATACAGGCCGAAGTGAA<br>GCTGGTGGAAAGCGGCGGAGGCCTGGTGCAGC<br>CTGGCGGCAGCCTGAGACTGAGCTGCGCCACC<br>AGCGGCTTCACCTTCACCGACTTCTACATGAGC<br>TGGGTCCGACAGCCCCCTGGCAAGGCCCTGGA<br>ATGGCTGGCCTTCATCCGGAACAAGGCCAACG<br>GCTACACCACCGAGTACAGCAGCAGCGTGCGG<br>GGCAGATTCACCATCAGCCGGGACAACAGCCA<br>GAGCATCCTGTACCTGCAGATGAACACCCTGC<br>GGGCCGAGGACAGCGGCACCTACTACTGCGCC<br>AGGGACGTGGGCGACTACGACTACTGGGGCCA<br>GGGCAGCACCCTGACCGTGTCCTCTGCCAAAA<br>CAACAGCACCAAGTGTCTATCCACTGGCCCCT<br>GTGTGTGGAGATACAACTGGCTCCTCGGTGAC<br>TCTAGGATGCCTGGTCAAGGGTTATTTCCCTGA<br>GCCAGTGACCTTGACCTGGAACTCTGGATCCCT<br>GTCCAGTGGTGTGCACACCTTCCCAGCTGTCCT<br>GCAGTCTGACCTCTACACCCTCAGCAGCTCAGT<br>GACTGTAACCTCGAGCACCTGGCCCAGCCAGT<br>CCATCACCTGCAATGTGGCCCACCGGCAAGC | 1167 |

TABLE 47-continued

HlgA/LukE Antibody Heavy Chain Primary Transcripts

| mAB/Fab name | Construct ID | Heavy Chain Primary Transcript | SEQ ID NO: |
|---|---|---|---|
| | | AGCACCAAGGTGGACAAGAAAATTGAGCCCA GAGGGCCCACAATCAAGCCCTGTCCTCCATGC AAATGCCCAGCACCTAACCTCTTGGGTGGACC ATCCGTCTTCATCTTCCCTCCAAAGATCAAGGA TGTACTCATGATCTCCCTGAGCCCCATAGTCAC ATGTGTGGTGGTGGATGTGAGCGAGGATGACC CAGATGTCCAGATCAGCTGGTTTGTGAACAAC GTGGAAGTACACACAGCTCAGACACAAACCCA TAGAGAGGATTACAACAGTACTCTCCGGGTGG TCAGTGCCCTCCCCATCCAGCACCAGGACTGG ATGAGTGGCAAGGAGTTCAAATGCAAGGTCAA CAACAAAGACCTCCCAGCGCCCATCGAGAGAA CCATCTCAAAACCCAAAGGGTCAGTAAGAGCT CCACAGGTATATGTCTTGCCTCCACCAGAAGA AGAGATGACTAAGAAACAGGTCACTCTGACCT GCATGGTCACAGACTTCATGCCTGAAGACATT TACGTGGAGTGGACCAACAACGGGAAAACAG AGCTAAACTACAAGAACACTGAACCAGTCCTG GACTCTGATGGTTCTTACTTCATGTACAGCAAG CTGAGAGTGGAAAAGAAGAACTGGGTGGAAA GAAATAGCTACTCCTGTTCAGTGGTCCACGAG GGTCTGCACAATCACCACACGACTAAGAGCTT CTCCCGGACTCCGGGTAAATGA | |
| SM1B305 | pDR000029293 | ATGGCTTGGGTGTGGACCTTGCTATTCCTGATG GCAGCTGCCCAAAGTATACAGGCCCAGATCCA GCTGGTGCAGAGCGGCCCTGAGCTGAAGAAAC CCGGCGAGACAGTGAAGATCAGCTGCAAGGCC AGCGGCTTCACCTTCACCAACTACGGCATGAA CTGGGTCAAGCAGGCCCCTGGCAAGGACCTGA AGTGGATGGGCTGGATCAACACCTACACCGGC GAGCCCACCTACGCCGACGACTTCAAGGGCAG ATTCGCCTTCAGCCTGGAAACCAGCGCCAGCA CCGCCTACCTGCAGATCAACAACCTGAAGGAC GAGGATACCGCCAGCTACTTCTGCGCCAGAGA CTACCGGGACGGCGACGCCCTGGATTACTGGG GCCAGGGCACCAGCGTGACCGTGTCCTCTGCC AAAACAACAGCACCAAGTGTCTATCCACTGGC CCCTGTGTGTGGAGATACAACTGGCTCCTCGGT GACTCTAGGATGCCTGGTCAAGGGTTATTTCCC TGAGCCAGTGACCTTGACCTGGAACTCTGGAT CCCTGTCCAGTGGTGTGCACACCTTCCCAGCTG TCCTGCAGTCTGACCTCTACACCCTCAGCAGCT CAGTGACTGTAACCTCGAGCACCTGGCCCAGC CAGTCCATCACCTGCAATGTGGCCCACCCGGC AAGCAGCACCAAGGTGGACAAGAAAATTGAG CCCAGAGGGCCCACAATCAAGCCCTGTCCTCC ATGCAAATGCCCAGCACCTAACCTCTTGGGTG GACCATCCGTCTTCATCTTCCCTCCAAAGATCA AGGATGTACTCATGATCTCCCTGAGCCCCATA GTCACATGTGTGGTGGTGGATGTGAGCGAGGA TGACCCAGATGTCCAGATCAGCTGGTTTGTGA ACAACGTGGAAGTACACACAGCTCAGACACAA ACCCATAGAGAGGATTACAACAGTACTCTCCG GGTGGTCAGTGCCCTCCCCATCCAGCACCAGG ACTGGATGAGTGGCAAGGAGTTCAAATGCAAG GTCAACAACAAAGACCTCCCAGCGCCCATCGA GAGAACCATCTCAAAACCCAAAGGGTCAGTAA GAGCTCCACAGGTATATGTCTTGCCTCCACCAG AAGAAGAGATGACTAAGAAACAGGTCACTCTG ACCTGCATGGTCACAGACTTCATGCCTGAAGA CATTTACGTGGAGTGGACCAACAACGGGAAAA CAGAGCTAAACTACAAGAACACTGAACCAGTC CTGGACTCTGATGGTTCTTACTTCATGTACAGC AAGCTGAGAGTGGAAAAGAAGAACTGGGTGG AAAGAAATAGCTACTCCTGTTCAGTGGTCCAC GAGGGTCTGCACAATCACCACACGACTAAGAG CTTCTCCCGGACTCCGGGTAAATGA | 1168 |
| SM1B306 | pDR000029292 | ATGGCTTGGGTGTGGACCTTGCTATTCCTGATG GCAGCTGCCCAAAGTATACAGGCCCAGGTGCA GCTGCAGCAGCCTGGCGCCGAACTCGTCAGAC CTGGCGCCAGCGTGAAGCTGAGCTGCAAGGCC AGCGGCTACAGCTTCACCAGCAACTGGATGAA TTGGATGAAGCAGCGGCCTGGCCAGGGCCTGG | 1169 |

TABLE 47-continued

HlgA/LukE Antibody Heavy Chain Primary Transcripts

| mAB/Fab name | Construct ID | Heavy Chain Primary Transcript | SEQ ID NO: |
|---|---|---|---|
| | | AATGGATCGGCATGATCCACCCCAGCGACAGC<br>GAGAGCCGGCTGAACCAGAAGTTCAAGGACA<br>AGGCCACCCTGACCGTGGACAAGAGCAGCAGC<br>ACCGCCTACATGCAGCTGTCCAGCCCCACCAG<br>CGAGGACAGCGCCGTGTACTACTGTGCCAGAG<br>GCGACGGCGGCTTCGCCTACTGGGGACAGGGC<br>ACCCTGGTCACCGTGTCCGCTGCCAAAACAAC<br>AGCACCAAGTGTCTATCCACTGGCCCCTGTGTG<br>TGGAGATACAACTGGCTCCTCGGTGACTCTAG<br>GATGCCTGGTCAAGGGTTATTTCCCTGAGCCA<br>GTGACCTTGACCTGGAACTCTGGATCCCTGTCC<br>AGTGGTGTGCACACCTTCCCAGCTGTCCTGCAG<br>TCTGACCTCTACACCCTCAGCAGCTCAGTGACT<br>GTAACCTCGAGCACCTGGCCCAGCCAGTCCAT<br>CACCTGCAATGTGGCCCACCCGGCAAGCAGCA<br>CCAAGGTGGACAAGAAAATTGAGCCCAGAGG<br>GCCCACAATCAAGCCCTGTCCTCCATGCAAAT<br>GCCCAGCACCTAACCTCTTGGGTGGACCATCC<br>GTCTTCATCTTCCCTCCAAAGATCAAGGATGTA<br>CTCATGATCTCCCTGAGCCCCATAGTCACATGT<br>GTGGTGGTGGATGTGAGCGAGGATGACCCAGA<br>TGTCCAGATCAGCTGGTTTGTGAACAACGTGG<br>AAGTACACACAGCTCAGACACAAACCCATAGA<br>GAGGATTACAACAGTACTCTCCGGGTGGTCAG<br>TGCCCTCCCCATCCAGCACCAGGACTGGATGA<br>GTGGCAAGGAGTTCAAATGCAAGGTCAACAAC<br>AAAGACCTCCCAGCGCCCATCGAGAGAACCAT<br>CTCAAAACCCAAAGGGTCAGTAAGAGCTCCAC<br>AGGTATATGTCTTGCCTCCACCAGAAGAAGAG<br>ATGACTAAGAAACAGGTCACTCTGACCTGCAT<br>GGTCACAGACTTCATGCCTGAAGACATTTACG<br>TGGAGTGGACCAACAACGGGAAAACAGAGCT<br>AAACTACAAGAACACTGAACCAGTCCTGGACT<br>CTGATGGTTCTTACTTCATGTACAGCAAGCTGA<br>GAGTGGAAAAGAAGAACTGGGTGGAAAGAAA<br>TAGCTACTCCTGTTCAGTGGTCCACGAGGGTCT<br>GCACAATCACCACACGACTAAGAGCTTCTCCC<br>GGACTCCGGGTAAATGA | |
| SM1B307 | pDR000029291 | ATGGCTTGGGTGTGGACCTTGCTATTCCTGATG<br>GCAGCTGCCCAAAGTATACAGGCCGAAGTGAA<br>GCTGCAGCAGAGCGGGCCCTGAGCTGGTCAAGC<br>CTGGCGCCAGCATGAAGATCAGCTGCAAGGCC<br>AGCGGCTACAGCTTCACCGGCTACACCATGAA<br>CTGGGCCAAGCAGAGCCACGGCAAGAACCTGG<br>AATGGATCGGCCTGATCAACCCCTACAACGGC<br>GGCACCAGCTACAACCAGAAGTTCAAGGGCAA<br>GGCCACCCTGACCGTGGACAAGAGCAGCAGCA<br>CCGCCTACATGGAACTGCTGAGCCTGACCAGC<br>GAGGACAGCGCCGTGTACTACTGCGCCAGAGG<br>CTACCCCAGAGGATGGTTCGCCTACTGGGGCC<br>AGGGCACCCTGGTCACCGTGTCTGCTGCCAAA<br>ACAACAGCACCAAGTGTCTATCCACTGGCCCC<br>TGTGTGTGGAGATACAACTGGCTCCTCGGTGA<br>CTCTAGGATGCCTGGTCAAGGGTTATTTCCCTG<br>AGCCAGTGACCTTGACCTGGAACTCTGGATCC<br>CTGTCCAGTGGTGTGCACACCTTCCCAGCTGTC<br>CTGCAGTCTGACCTCTACACCCTCAGCAGCTCA<br>GTGACTGTAACCTCGAGCACCTGGCCCAGCCA<br>GTCCATCACCTGCAATGTGGCCCACCCGGCAA<br>GCAGCACCAAGGTGGACAAGAAAATTGAGCCC<br>AGAGGGCCCACAATCAAGCCCTGTCCTCCATG<br>CAAATGCCCAGCACCTAACCTCTTGGGTGGAC<br>CATCCGTCTTCATCTTCCCTCCAAAGATCAAGG<br>ATGTACTCATGATCTCCCTGAGCCCCATAGTCA<br>CATGTGTGGTGGTGGATGTGAGCGAGGATGAC<br>CCAGATGTCCAGATCAGCTGGTTTGTGAACAA<br>CGTGGAAGTACACACAGCTCAGACACAAACCC<br>ATAGAGAGGATTACAACAGTACTCTCCGGGTG<br>GTCAGTGCCCTCCCCATCCAGCACCAGGACTG<br>GATGAGTGGCAAGGAGTTCAAATGCAAGGTCA<br>ACAACAAAGACCTCCCAGCGCCCATCGAGAGA<br>ACCATCTCAAAACCCAAAGGGTCAGTAAGAGC<br>TCCACAGGTATATGTCTTGCCTCCACCAGAAG<br>AAGAGATGACTAAGAAACAGGTCACTCTGACC | 1170 |

TABLE 47-continued

HlgA/LukE Antibody Heavy Chain Primary Transcripts

| mAB/Fab name | Construct ID | Heavy Chain Primary Transcript | SEQ ID NO: |
|---|---|---|---|
| | | TGCATGGTCACAGACTTCATGCCTGAAGACAT TTACGTGGAGTGGACCAACAACGGGAAAACAG AGCTAAACTACAAGAACACTGAACCAGTCCTG GACTCTGATGGTTCTTACTTCATGTACAGCAAG CTGAGAGTGGAAAAGAAGAACTGGGTGGAAA GAAATAGCTACTCCTGTTCAGTGGTCCACGAG GGTCTGCACAATCACCACACGACTAAGAGCTT CTCCCGGACTCCGGGTAAATGA | |
| SM1B308 | pDR000029290 | ATGGCTTGGGTGTGGACCTTGCTATTCCTGATG GCAGCTGCCCAAAGTATACAGGCCGACGTGAA GCTGGTGGAAAGCGGCGGAGGCCTGGTCAAGC CTGGCGGCAGCCTGAAGCTGAGCTGCGCCGCC AGCGGCTTCACCTTCCGGAACCACGCCATGAG CTGGGTCCGACAGACCCCCGAGAAGCGGCTGG AATGGGTGGCCGCCATCAACGTGAACGCCGGC AGCACCTACTACCCCGACACCGTGAAGGACCG GTTCACCATCAGCCGGGACAACGCCAAGAACA CCCTGTACCTGCAGATGAGCAGCCTGCGGAGC GAGGACACCGCCCTGTACTACTGCGCCAGACA CCGGGCCTACTACAACTACGACGAGAACGCCA TGGACTACTGGGGCCAGGGCACCAGCGTGACC GTGTCCTCTGCCAAAACAACAGCACCAAGTGT CTATCCACTGGCCCCTGTGTGTGGAGATACAA CTGGCTCCTCGGTGACTCTAGGATGCCTGGTCA AGGGTTATTTCCCTGAGCCAGTGACCTTGACCT GGAACTCTGGATCCCTGTCCAGTGGTGTGCAC ACCTTCCCAGCTGTCCTGCAGTCTGACCTCTAC ACCCTCAGCAGCTCAGTGACTGTAACCTCGAG CACCTGGCCCAGCCAGTCCATCACCTGCAATG TGGCCCACCCGGCAAGCAGCACCAAGGTGGAC AAGAAAATTGAGCCCAGAGGGCCCACAATCAA GCCCTGTCCTCCATGCAAATGCCCAGCACCTA ACCTCTTGGGTGGACCATCCGTCTTCATCTTCC CTCCAAAGATCAAGGATGTACTCATGATCTCC CTGAGCCCCATAGTCACATGTGTGGTGGTGGA TGTGAGCGAGGATGACCCAGATGTCCAGATCA GCTGGTTTGTGAACAACGTGGAAGTACACACA GCTCAGACACAAACCCATAGAGAGGATTACAA CAGTACTCTCCGGGTGGTCAGTGCCCTCCCCAT CCAGCACCAGGACTGGATGAGTGGCAAGGAGT TCAAATGCAAGGTCAACAACAAAGACCTCCCA GCGCCCATCGAGAGAACCATCTCTAAAACCCAA AGGGTCAGTAAGAGCTCCACAGGTATATGTCT TGCCTCCACCAGAAGAAGAGATGACTAAGAAA CAGGTCACTCTGACCTGCATGGTCACAGACTTC ATGCCTGAAGACATTTACGTGGAGTGGACCAA CAACGGGAAAACAGAGCTAAACTACAAGAAC ACTGAACCAGTCCTGGACTCTGATGGTTCTTAC TTCATGTACAGCAAGCTGAGAGTGGAAAAGAA GAACTGGGTGGAAAGAAATAGCTACTCCTGTT CAGTGGTCCACGAGGGTCTGCACAATCACCAC ACGACTAAGAGCTTCTCCCGGACTCCGGGTAA ATGA | 1171 |
| SM1B309 | pDR000029289 | ATGGCTTGGGTGTGGACCTTGCTATTCCTGATG GCAGCTGCCCAAAGTATACAGGCCGAGGTGCA GCTGCAGCAGAGCGGCCCTGAGCTGGTCAAGC CCGGCGACAGCGTGAAGATGAGCTGCAAGGCC AGCGGCTACACCTTCACCGACTACTACATCGA CTGGATGAAGCAGAGCCACGGCAAGAGCCTGG AATGGATCGGCTACATCTACCCCAACAACGGC GGCACCAGCTACAACCAGAACTTCAAGGACAA GGCCACCCTGACCGTGGACAAGAGCAGCAGCA CCGCCTACATGGAACTGCACAGCCTGACCAGC GAGGACAGCGCCGTGTACTACTGCGCCAGACT GACCTACTACGCCAAGGTGGACAGCTGGGGCC AGGGCACCAGCGTGACCGTGTCTAGCGCCAAA ACAACAGCACCAAGTGTCTATCCACTGGCCCC TGTGTGTGGAGATACAACTGGCTCCTCGGTGA CTCTAGGATGCCTGGTCAAGGGTTATTTCCCTG AGCCAGTGACCTTGACCTGGAACTCTGGATCC CTGTCCAGTGGTGTGCACACCTTCCCAGCTGTC CTGCAGTCTGACCTCTACACCCTCAGCAGCTCA GTGACTGTAACCTCGAGCACCTGGCCCAGCCA | 1172 |

TABLE 47-continued

HlgA/LukE Antibody Heavy Chain Primary Transcripts

| mAB/Fab name | Construct ID | Heavy Chain Primary Transcript | SEQ ID NO: |
|---|---|---|---|
| | | GTCCATCACCTGCAATGTGGCCCACCCGGCAA<br>GCAGCACCAAGGTGGACAAGAAAATTGAGCCC<br>AGAGGGCCCACAATCAAGCCCTGTCCTCCATG<br>CAAATGCCCAGCACCTAACCTCTTGGGTGGAC<br>CATCCGTCTTCATCTTCCCTCCAAAGATCAAGG<br>ATGTACTCATGATCTCCCTGAGCCCCATAGTCA<br>CATGTGTGGTGGTGGATGTGAGCGAGGATGAC<br>CCAGATGTCCAGATCAGCTGGTTTGTGAACAA<br>CGTGGAAGTACACACAGCTCAGACACAAACCC<br>ATAGAGAGGATTACAACAGTACTCTCCGGGTG<br>GTCAGTGCCCTCCCCATCCAGCACCAGGACTG<br>GATGAGTGGCAAGGAGTTCAAATGCAAGGTCA<br>ACAACAAAGACCTCCCAGCGCCCATCGAGAGA<br>ACCATCTCAAAACCCAAAGGGTCAGTAAGAGC<br>TCCACAGGTATATGTCTTGCCTCCACCAGAAG<br>AAGAGATGACTAAGAAACAGGTCACTCTGACC<br>TGCATGGTCACAGACTTCATGCCTGAAGACAT<br>TTACGTGGAGTGGACCAACAACGGGAAAACAG<br>AGCTAAACTACAAGAACACTGAACCAGTCCTG<br>GACTCTGATGGTTCTTACTTCATGTACAGCAAG<br>CTGAGAGTGGAAAAGAAGAACTGGGTGGAAA<br>GAAATAGCTACTCCTGTTCAGTGGTCCACGAG<br>GGTCTGCACAATCACCACACGACTAAGAGCTT<br>CTCCCCGGACTCCGGGTAAATGA | |
| SM1B310 | pDR000029288 | ATGGCTTGGGTGTGGACCTTGCTATTCCTGATG<br>GCAGCTGCCCAAAGTATACAGGCCGACGTGAA<br>GCTGGTGGAAAGCGGCGGAGGCCTGGTGGAAT<br>GGGAGGGCGTGCTGAAGCTGAGCTGCGCCGCC<br>AGCGGCTTCACCTTCAGCAGCTACGCCATGAG<br>CTGGGTCCGACAGACCCCCGAGAAGCGGCTGG<br>AATGGGTGGCCGCCATCAACAGCAACGGCGGC<br>AGCACCTACTACCCCGACACCGTGAAGGACCG<br>GTTCACCATCAGCCGGGACAACGCCAAGAACA<br>CCCTGTACCTGCAGATGAGCAGCCTGCGGAGC<br>GAGGACACCGCCCTGTACTACTGCGCCAGACT<br>GTACTACGGCGACTACTGGGGCCAGGGCACCA<br>CCCTGACCGTGTCCTCTGCCAAAACAACAGCA<br>CCAAGTGTCTATCCACTGGCCCCTGTGTGTGGA<br>GATACAACTGGCTCCTCGGTGACTCTAGGATG<br>CCTGGTCAAGGGTTATTTCCCTGAGCCAGTGAC<br>CTTGACCTGGAACTCTGGATCCCTGTCCAGTGG<br>TGTGCACACCTTCCCAGCTGTCCTGCAGTCTGA<br>CCTCTACACCCTCAGCAGCTCAGTGACTGTAAC<br>CTCGAGCACCTGGCCCAGCCAGTCCATCACCT<br>GCAATGTGGCCCACCCGGCAAGCAGCACCAAG<br>GTGGACAAGAAAATTGAGCCCAGAGGGCCCAC<br>AATCAAGCCCTGTCCTCCATGCAAATGCCCAG<br>CACCTAACCTCTTGGGTGGACCATCCGTCTTCA<br>TCTTCCCTCCAAAGATCAAGGATGTACTCATGA<br>TCTCCCTGAGCCCCATAGTCACATGTGTGGTGG<br>TGGATGTGAGCGAGGATGACCCAGATGTCCAG<br>ATCAGCTGGTTTGTGAACAACGTGGAAGTACA<br>CACAGCTCAGACACAAACCCATAGAGAGGATT<br>ACAACAGTACTCTCCGGGTGGTCAGTGCCCTC<br>CCCATCCAGCACCAGGACTGGATGAGTGGCAA<br>GGAGTTCAAATGCAAGGTCAACAACAAAGACC<br>TCCCAGCGCCCATCGAGAGAACCATCTCAAAA<br>CCCAAAGGGTCAGTAAGAGCTCCACAGGTATA<br>TGTCTTGCCTCCACCAGAAGAAGAGATGACTA<br>AGAAACAGGTCACTCTGACCTGCATGGTCACA<br>GACTTCATGCCTGAAGACATTTACGTGGAGTG<br>GACCAACAACGGGAAAACAGAGCTAAACTAC<br>AAGAACACTGAACCAGTCCTGGACTCTGATGG<br>TTCTTACTTCATGTACAGCAAGCTGAGAGTGG<br>AAAAGAAGAACTGGGTGGAAAGAAATAGCTA<br>CTCCTGTTCAGTGGTCCACGAGGGTCTGCACA<br>ATCACCACACGACTAAGAGCTTCTCCCCGGACT<br>CCGGGTAAATGA | 1173 |
| SM1B311 | pDR000029287 | ATGGCTTGGGTGTGGACCTTGCTATTCCTGATG<br>GCAGCTGCCCAAAGTATACAGGCCCAGGTGCA<br>GCTGAAGCAGAGCGGCCCTAGCCTGGTGCAGC<br>CCAGCCAGAGCCTGAGCATCACCTGTACCGTG<br>TCCGGCTTCAGCCTGACCACCTACGGCCTGCAC | 1174 |

TABLE 47-continued

HlgA/LukE Antibody Heavy Chain Primary Transcripts

| mAB/Fab name | Construct ID | Heavy Chain Primary Transcript | SEQ ID NO: |
|---|---|---|---|
| | | TGGATCCGGCAGAGCCCCGGCAAGGGCCTGGA ATGGCTGGGAGTGATTTGGAGAGGCGGCACCA CCGACTACAACGCCGCCTTCATGAGCCGGCTG ACCATCACCAAGGACAACAGCAAGAGCCAGGT GTTCTTCAAGATGAACAGCCTGCAGGCCGACG ACACCGCCATCTACTACTGCGCCCGGACCGAC ATCTGGGGCGCTGGCACCACCGTGACCGTGTC CTCTGCCAAAACAACAGCACCAAGTGTCTATC CACTGGCCCCTGTGTGTGGAGATACAACTGGC TCCTCGGTGACTCTAGGATGCCTGGTCAAGGG TTATTTCCCTGAGCCAGTGACCTTGACCTGGAA CTCTGGATCCCTGTCCAGTGGTGTGCACACCTT CCCAGCTGTCCTGCAGTCTGACCTCTACACCCT CAGCAGCTCAGTGACTGTAACCTCGAGCACCT GGCCCAGCCAGTCCATCACCTGCAATGTGGCC CACCCGGCAAGCAGCACCAAGGTGGACAAGA AAATTGAGCCCAGAGGGCCCACAATCAAGCCC TGTCCTCCATGCAAATGCCCAGCACCTAACCTC TTGGGTGGACCATCCGTCTTCATCTTCCCTCCA AAGATCAAGGATGTACTCATGATCTCCCTGAG CCCCATAGTCACATGTGTGGTGGTGGATGTGA GCGAGGATGACCCAGATGTCCAGATCAGCTGG TTTGTGAACAACGTGGAAGTACACACAGCTCA GACACAAACCCATAGAGAGGATTACAACAGTA CTCTCCGGGTGGTCAGTGCCCTCCCCATCCAGC ACCAGGACTGGATGAGTGGCAAGGAGTTCAAA TGCAAGGTCAACAACAAAGACCTCCCAGCGCC CATCGAGAGAACCATCTCAAAACCCAAAGGGT CAGTAAGAGCTCCACAGGTATATGTCTTGCCTC CACCAGAAGAAGAGATGACTAAGAAACAGGT CACTCTGACCTGCATGGTCACAGACTTCATGCC TGAAGACATTTACGTGGAGTGGACCAACAACG GGAAAACAGAGCTAAACTACAAGAACACTGA ACCAGTCCTGGACTCTGATGGTTCTTACTTCAT GTACAGCAAGCTGAGAGTGGAAAAGAAGAAC TGGGTGGAAAGAAATAGCTACTCCTGTTCAGT GGTCCACGAGGGTCTGCACAATCACCACACGA CTAAGAGCTTCTCCCGGACTCCGGGTAAATGA | |
| SM1B312 | pDR000029287 | ATGGCTTGGGTGTGGACCTTGCTATTCCTGATG GCAGCTGCCCAAAGTATACAGGCCCAGGTGCA GCTGAAGCAGAGCGGCCCTAGCCTGGTGCAGC CCAGCCAGAGCCTGAGCATCACCTGTACCGTG TCCGGCTTCAGCCTGACCACCTACGGCCTGCAC TGGATCCGGCAGAGCCCCGGCAAGGGCCTGGA ATGGCTGGGAGTGATTTGGAGAGGCGGCACCA CCGACTACAACGCCGCCTTCATGAGCCGGCTG ACCATCACCAAGGACAACAGCAAGAGCCAGGT GTTCTTCAAGATGAACAGCCTGCAGGCCGACG ACACCGCCATCTACTACTGCGCCCGGACCGAC ATCTGGGGCGCTGGCACCACCGTGACCGTGTC CTCTGCCAAAACAACAGCACCAAGTGTCTATC CACTGGCCCCTGTGTGTGGAGATACAACTGGC TCCTCGGTGACTCTAGGATGCCTGGTCAAGGG TTATTTCCCTGAGCCAGTGACCTTGACCTGGAA CTCTGGATCCCTGTCCAGTGGTGTGCACACCTT CCCAGCTGTCCTGCAGTCTGACCTCTACACCCT CAGCAGCTCAGTGACTGTAACCTCGAGCACCT GGCCCAGCCAGTCCATCACCTGCAATGTGGCC CACCCGGCAAGCAGCACCAAGGTGGACAAGA AAATTGAGCCCAGAGGGCCCACAATCAAGCCC TGTCCTCCATGCAAATGCCCAGCACCTAACCTC TTGGGTGGACCATCCGTCTTCATCTTCCCTCCA AAGATCAAGGATGTACTCATGATCTCCCTGAG CCCCATAGTCACATGTGTGGTGGTGGATGTGA GCGAGGATGACCCAGATGTCCAGATCAGCTGG TTTGTGAACAACGTGGAAGTACACACAGCTCA GACACAAACCCATAGAGAGGATTACAACAGTA CTCTCCGGGTGGTCAGTGCCCTCCCCATCCAGC ACCAGGACTGGATGAGTGGCAAGGAGTTCAAA TGCAAGGTCAACAACAAAGACCTCCCAGCGCC CATCGAGAGAACCATCTCAAAACCCAAAGGGT CAGTAAGAGCTCCACAGGTATATGTCTTGCCTC CACCAGAAGAAGAGATGACTAAGAAACAGGT CACTCTGACCTGCATGGTCACAGACTTCATGCC | 1175 |

TABLE 47-continued

HlgA/LukE Antibody Heavy Chain Primary Transcripts

| mAB/Fab name | Construct ID | Heavy Chain Primary Transcript | SEQ ID NO: |
|---|---|---|---|
| | | TGAAGACATTTACGTGGAGTGGACCAACAACG GGAAAACAGAGCTAAACTACAAGAACACTGA ACCAGTCCTGGACTCTGATGGTTCTTACTTCAT GTACAGCAAGCTGAGAGTGGAAAAGAAGAAC TGGGTGGAAAGAAATAGCTACTCCTGTTCAGT GGTCCACGAGGGTCTGCACAATCACCACACGA CTAAGAGCTTCTCCCGGACTCCGGGTAAATGA | |
| SM1B313 | pDR000029287 | ATGGCTTGGGTGTGGACCTTGCTATTCCTGATG GCAGCTGCCCAAAGTATACAGGCCCAGGTGCA GCTGAAGCAGAGCGGCCCTAGCCTGGTGCAGC CCAGCCAGAGCCTGAGCATCACCTGTACCGTG TCCGGCTTCAGCCTGACCACCTACGGCCTGCAC TGGATCCGGCAGAGCCCCGGCAAGGGCCTGGA ATGGCTGGGAGTGATTTGGAGAGGCGGCACCA CCGACTACAACGCCGCCTTCATGAGCCGGCTG ACCATCACCAAGGACAACAGCAAGAGCCAGGT GTTCTTCAAGATGAACAGCCTGCAGGCCGACG ACACCGCCATCTACTACTGCGCCCGGACCGAC ATCTGGGGCGCTGGCACCACCGTGACCGTGTC CTCTGCCAAAACAACAGCACCAAGTGTCTATC CACTGGCCCCTGTGTGTGGAGATACAACTGGC TCCTCGGTGACTCTAGGATGCCTGGTCAAGGG TTATTTCCCTGAGCCAGTGACCTTGACCTGGAA CTCTGGATCCCTGTCCAGTGGTGTGCACACCTT CCCAGCTGTCCTGCAGTCTGACCTCTACACCCT CAGCAGCTCAGTGACTGTAACCTCGAGCACCT GGCCCAGCCAGTCCATCACCTGCAATGTGGCC CACCCGGCAAGCAGCACCAAGGTGGACAAGA AAATTGAGCCCAGAGGGCCCACAATCAAGCCC TGTCCTCCATGCAAATGCCCAGCACCTAACCTC TTGGGTGGACCATCCGTCTTCATCTTCCCTCCA AAGATCAAGGATGTACTCATGATCTCCCTGAG CCCCATAGTCACATGTGTGGTGGTGGATGTGA GCGAGGATGACCCAGATGTCCAGATCAGCTGG TTTGTGAACAACGTGGAAGTACACACAGCTCA GACACAAACCCATAGAGAGGATTACAACAGTA CTCTCCGGGTGGTCAGTGCCCTCCCCATCCAGC ACCAGGACTGGATGAGTGGCAAGGAGTTCAAA TGCAAGGTCAACAACAAAGACCTCCCAGCGCC CATCGAGAGAACCATCTCAAAACCCAAAGGGT CAGTAAGAGCTCCACAGGTATATGTCTTGCCTC CACCAGAAGAAGAGATGACTAAGAAACAGGT CACTCTGACCTGCATGGTCACAGACTTCATGCC TGAAGACATTTACGTGGAGTGGACCAACAACG GGAAAACAGAGCTAAACTACAAGAACACTGA ACCAGTCCTGGACTCTGATGGTTCTTACTTCAT GTACAGCAAGCTGAGAGTGGAAAAGAAGAAC TGGGTGGAAAGAAATAGCTACTCCTGTTCAGT GGTCCACGAGGGTCTGCACAATCACCACACGA CTAAGAGCTTCTCCCGGACTCCGGGTAAATGA | 1176 |
| SM1B314 | pDR000029286 | ATGGCTTGGGTGTGGACCTTGCTATTCCTGATG GCAGCTGCCCAAAGTATACAGGCCCAGGTGCA GCTGAAGCAGAGCGGCCCTGGCCTGGTGCAGC CTAGCCAGAGCCTGCCCATCACCTGTACCGTGT CCGGCTTCAGCCTGACCACCTACGGCCTGCACT GGATCCGGCAGAGCCCCGGCAAGGGCCTGGAA TGGCTGGGAGTGATTTGGAGAGGCGGCACCAC CGACTACAACGCCGCCTTCATGAGCCGGCTGA CCATCACCAAGGACAACAGCAAGAGCCAGGTG TTCTTCAAGATGAACAGCCTGCAGGCCGACGA CACCGCCATCTACTACTGCGCCCGGACCGACA TCTGGGGCGCTGGCACCACCGTGACCGTGTCC TCTGCCAAAACAACAGCACCAAGTGTCTATCC ACTGGCCCCTGTGTGTGGAGATACAACTGGCT CCTCGGTGACTCTAGGATGCCTGGTCAAGGGT TATTTCCCTGAGCCAGTGACCTTGACCTGGAAC TCTGGATCCCTGTCCAGTGGTGTGCACACCTTC CCAGCTGTCCTGCAGTCTGACCTCTACACCCTC AGCAGCTCAGTGACTGTAACCTCGAGCACCTG GCCCAGCCAGTCCATCACCTGCAATGTGGCCC ACCCGGCAAGCAGCACCAAGGTGGACAAGAA AATTGAGCCCAGAGGGCCCACAATCAAGCCCT GTCCTCCATGCAAATGCCCAGCACCTAACCTCT | 1177 |

TABLE 47-continued

HlgA/LukE Antibody Heavy Chain Primary Transcripts

| mAB/Fab name | Construct ID | Heavy Chain Primary Transcript | SEQ ID NO: |
|---|---|---|---|
| | | TGGGTGGACCATCCGTCTTCATCTTCCCTCCAA<br>AGATCAAGGATGTACTCATGATCTCCCTGAGC<br>CCCATAGTCACATGTGTGGTGGTGGATGTGAG<br>CGAGGATGACCCAGATGTCCAGATCAGCTGGT<br>TTGTGAACAACGTGGAAGTACACACAGCTCAG<br>ACACAAACCCATAGAGAGGATTACAACAGTAC<br>TCTCCGGGTGGTCAGTGCCCTCCCCATCCAGCA<br>CCAGGACTGGATGAGTGGCAAGGAGTTCAAAT<br>GCAAGGTCAACAACAAAGACCTCCCAGCGCCC<br>ATCGAGAGAACCATCTCAAAACCCAAAGGGTC<br>AGTAAGAGCTCCACAGGTATATGTCTTGCCTCC<br>ACCAGAAGAAGAGATGACTAAGAAACAGGTC<br>ACTCTGACCTGCATGGTCACAGACTTCATGCCT<br>GAAGACATTTACGTGGAGTGGACCAACAACGG<br>GAAAACAGAGCTAAACTACAAGAACACTGAA<br>CCAGTCCTGGACTCTGATGGTTCTTACTTCATG<br>TACAGCAAGCTGAGAGTGGAAAAGAAGAACT<br>GGGTGGAAAGAAATAGCTACTCCTGTTCAGTG<br>GTCCACGAGGGTCTGCACAATCACCACACGAC<br>TAAGAGCTTCTCCCGGACTCCGGGTAAATGA | |
| SM1B315 | pDR000029285 | ATGGCTTGGGTGTGGACCTTGCTATTCCTGATG<br>GCAGCTGCCCAAAGTATACAGGCCCAGGTGCA<br>GCTGAAGCAGAGCGGCCCTGGCCTGGTGCAGC<br>CTAGCCAGAGCCTGAGCATCACCTGTACCGTG<br>TCCGGCTTCAGCCTGACCACCTACGGCCTGCAC<br>TGGATCCGGCAGAGCCCCGGCAAGGGCCTGGA<br>ATGGCTGGGAGTGATTTGGAGAGGCGGCACCA<br>CCGACTACAACGCCGCCTTCATGAGCCGGCTG<br>ACCATCACCAAGGACAACAGCAAGAGCCAGGT<br>GTTCTTCAAGATGAACAGCCTGCAGGCCGACG<br>ACACCGCCATCTACTACTGCGCCCCGGACCGAC<br>ATCTGGGGCGCTGGCACCACCGTGACCGTGTC<br>CTCTGCCAAAACAACAGCACCAAGTGTCTATC<br>CACTGGCCCCTGTGTGTGGAGATACAACTGGC<br>TCCTCGGTGACTCTAGGATGCCTGGTCAAGGG<br>TTATTTCCCTGAGCCAGTGACCTTGACCTGGAA<br>CTCTGGATCCCTGTCCAGTGGTGTGCACACCTT<br>CCCAGCTGTCCTGCAGTCTGACCTCTACACCCT<br>CAGCAGCTCAGTGACTGTAACCTCGAGCACCT<br>GGCCCAGCCAGTCCATCACCTGCAATGTGGCC<br>CACCCGGCAAGCAGCACCAAGGTGGACAAGA<br>AAATTGAGCCCAGAGGGCCCACAATCAAGCCC<br>TGTCCTCCATGCAAATGCCCAGCACCTAACCTC<br>TTGGGTGGACCATCCGTCTTCATCTTCCCTCCA<br>AAGATCAAGGATGTACTCATGATCTCCCTGAG<br>CCCCATAGTCACATGTGTGGTGGTGGATGTGA<br>GCGAGGATGACCCAGATGTCCAGATCAGCTGG<br>TTTGTGAACAACGTGGAAGTACACACAGCTCA<br>GACACAAACCCATAGAGAGGATTACAACAGTA<br>CTCTCCGGGTGGTCAGTGCCCTCCCCATCCAGC<br>ACCAGGACTGGATGAGTGGCAAGGAGTTCAAA<br>TGCAAGGTCAACAACAAAGACCTCCCAGCGCC<br>CATCGAGAGAACCATCTCAAAACCCAAAGGGT<br>CAGTAAGAGCTCCACAGGTATATGTCTTGCCTC<br>CACCAGAAGAAGAGATGACTAAGAAACAGGT<br>CACTCTGACCTGCATGGTCACAGACTTCATGCC<br>TGAAGACATTTACGTGGAGTGGACCAACAACG<br>GGAAAACAGAGCTAAACTACAAGAACACTGA<br>ACCAGTCCTGGACTCTGATGGTTCTTACTTCAT<br>GTACAGCAAGCTGAGAGTGGAAAAGAAGAAC<br>TGGGTGGAAAGAAATAGCTACTCCTGTTCAGT<br>GGTCCACGAGGGTCTGCACAATCACCACACGA<br>CTAAGAGCTTCTCCCGGACTCCGGGTAAATGA | 1178 |
| SM1B316 | pDR000029287 | ATGGCTTGGGTGTGGACCTTGCTATTCCTGATG<br>GCAGCTGCCCAAAGTATACAGGCCCAGGTGCA<br>GCTGAAGCAGAGCGGCCCTAGCCTGGTGCAGC<br>CCAGCCAGAGCCTGAGCATCACCTGTACCGTG<br>TCCGGCTTCAGCCTGACCACCTACGGCCTGCAC<br>TGGATCCGGCAGAGCCCCGGCAAGGGCCTGGA<br>ATGGCTGGGAGTGATTTGGAGAGGCGGCACCA<br>CCGACTACAACGCCGCCTTCATGAGCCGGCTG<br>ACCATCACCAAGGACAACAGCAAGAGCCAGGT<br>GTTCTTCAAGATGAACAGCCTGCAGGCCGACG | 1179 |

TABLE 47-continued

H1qA/LukE Antibody Heavy Chain Primary Transcripts

| mAB/Fab name | Construct ID | Heavy Chain Primary Transcript | SEQ ID NO: |
|---|---|---|---|
| | | ACACCGCCATCTACTACTGCGCCCGGACCGAC<br>ATCTGGGGCGCTGGCACCACCGTGACCGTGTC<br>CTCTGCCAAAACAACAGCACCAAGTGTCTATC<br>CACTGGCCCCTGTGTGTGGAGATACAACTGGC<br>TCCTCGGTGACTCTAGGATGCCTGGTCAAGGG<br>TTATTTCCCTGAGCCAGTGACCTTGACCTGGAA<br>CTCTGGATCCCTGTCCAGTGGTGTGCACACCTT<br>CCCAGCTGTCCTGCAGTCTGACCTCTACACCCT<br>CAGCAGCTCAGTGACTGTAACCTCGAGCACCT<br>GGCCCAGCCAGTCCATCACCTGCAATGTGGCC<br>CACCCGGCAAGCAGCACCAAGGTGGACAAGA<br>AAATTGAGCCCAGAGGGCCCACAATCAAGCCC<br>TGTCCTCCATGCAAATGCCCAGCACCTAACCTC<br>TTGGGTGGACCATCCGTCTTCATCTTCCCTCCA<br>AAGATCAAGGATGTACTCATGATCTCCCTGAG<br>CCCCATAGTCACATGTGTGGTGGTGGATGTGA<br>GCGAGGATGACCCAGATGTCCAGATCAGCTGG<br>TTTGTGAACAACGTGGAAGTACACACAGCTCA<br>GACACAAACCCATAGAGAGGATTACAACAGTA<br>CTCTCCGGGTGGTCAGTGCCCTCCCCATCCAGC<br>ACCAGGACTGGATGAGTGGCAAGGAGTTCAAA<br>TGCAAGGTCAACAACAAAGACCTCCCAGCGCC<br>CATCGAGAGAACCATCTCAAAACCCAAAGGGT<br>CAGTAAGAGCTCCACAGGTATATGTCTTGCCTC<br>CACCAGAAGAAGAGATGACTAAGAAACAGGT<br>CACTCTGACCTGCATGGTCACAGACTTCATGCC<br>TGAAGACATTTACGTGGAGTGGACCAACAACG<br>GGAAAACAGAGCTAAACTACAAGAACACTGA<br>ACCAGTCCTGGACTCTGATGGTTCTTACTTCAT<br>GTACAGCAAGCTGAGAGTGGAAAAGAAGAAC<br>TGGGTGGAAAGAAATAGCTACTCCTGTTCAGT<br>GGTCCACGAGGGTCTGCACAATCACCACACGA<br>CTAAGAGCTTCTCCCGGACTCCGGGTAAATGA | |
| SM1B317 | pDR000029284 | ATGGCTTGGGTGTGGACCTTGCTATTCCTGATG<br>GCAGCTGCCCAAAGTATACAGGCCCAGGTGCA<br>GCTGAAGCAGAGCGGCCCTGGCCTGGTGCAGC<br>CTAGCCAGAGCCTGAGCATCACCTGTACCGTG<br>TCCGGCTTCAGCCTGACCAGCTACGGCGTGCA<br>CTGGGTCCGACAGCCTCCCGGCAAGGGCCTGG<br>AATGGCTGGGAGTGATTTGGAGCGGCGGCATC<br>ACCGACTACAACGCCGCCTTCATCAGCAGACT<br>GAGCATCAGCAAGGACAACAGCAAGAGCCAG<br>GTGTTCTTCAAGATGAACAGCCTGCAGGCCGA<br>CGACACCGCCATCTACTACTGCGCCAGAACCG<br>ACCTGTGGGGCCAGGGCACCCTGGTCACAGTG<br>TCTGCCGCCAAAACAACAGCACCAAGTGTCTA<br>TCCACTGGCCCCTGTGTGTGGAGATACAACTG<br>GCTCCTCGGTGACTCTAGGATGCCTGGTCAAG<br>GGTTATTTCCCTGAGCCAGTGACCTTGACCTGG<br>AACTCTGGATCCCTGTCCAGTGGTGTGCACACC<br>TTCCCAGCTGTCCTGCAGTCTGACCTCTACACC<br>CTCAGCAGCTCAGTGACTGTAACCTCGAGCAC<br>CTGGCCCAGCCAGTCCATCACCTGCAATGTGG<br>CCCACCCGGCAAGCAGCACCAAGGTGGACAAG<br>AAAATTGAGCCCAGAGGGCCCACAATCAAGCC<br>CTGTCCTCCATGCAAATGCCCAGCACCTAACCT<br>CTTGGGTGGACCATCCGTCTTCATCTTCCCTCC<br>AAAGATCAAGGATGTACTCATGATCTCCCTGA<br>GCCCCATAGTCACATGTGTGGTGGTGGATGTG<br>AGCGAGGATGACCCAGATGTCCAGATCAGCTG<br>GTTTGTGAACAACGTGGAAGTACACACAGCTC<br>AGACACAAACCCATAGAGAGGATTACAACAGT<br>ACTCTCCGGGTGGTCAGTGCCCTCCCCATCCAG<br>CACCAGGACTGGATGAGTGGCAAGGAGTTCAA<br>ATGCAAGGTCAACAACAAAGACCTCCCAGCGC<br>CCATCGAGAGAACCATCTCAAAACCCAAAGGG<br>TCAGTAAGAGCTCCACAGGTATATGTCTTGCCT<br>CCACCAGAAGAAGAGATGACTAAGAAACAGG<br>TCACTCTGACCTGCATGGTCACAGACTTCATGC<br>CTGAAGACATTTACGTGGAGTGGACCAACAAC<br>GGGAAAACAGAGCTAAACTACAAGAACACTG<br>AACCAGTCCTGGACTCTGATGGTTCTTACTTCA<br>TGTACAGCAAGCTGAGAGTGGAAAAGAAGAA<br>CTGGGTGGAAAGAAATAGCTACTCCTGTTCAG | 1180 |

TABLE 47-continued

HlgA/LukE Antibody Heavy Chain Primary Transcripts

| mAB/Fab name | Construct ID | Heavy Chain Primary Transcript | SEQ ID NO: |
|---|---|---|---|
| | | TGGTCCACGAGGGTCTGCACAATCACCACACG ACTAAGAGCTTCTCCCGGACTCCGGGTAAATG A | |
| SM1B318 | pDR000029283 | ATGGCTTGGGTGTGGACCTTGCTATTCCTGATG GCAGCTGCCCAAAGTATACAGGCCCAGGTGCA GCTGCAGCAGTCTGGCGCCGAGCTGATGAACC CTGGCGCCAGCGTGAAGATCAGCTGCAAGAGC ACCGGCTACAAGTTCAGCAGCTACTGGATCGA GTGGGTCAAGCAGCGGCCTGGCCACGGCCTGG AATGGATGGGCGAGATCCTGCCTGGCAGCGGC AGCACCAACCACAACGAGAAGTTCAAGGGCA AGGCCATCTTCACCGCCGACGCCAGCAGCAAC ACCGCCTACATGGAACTGAGCAGCCTGACCAG CGAGGACAGCGCCGTGTACTACTGCGCCCGGA CCATCAGCACCGCCACCGATTGGTTCGCCTACT GGGGCCAGGGCACCCTGGTCACCGTGTCTGCT GCCAAAACAACAGCACCAAGTGTCTATCCACT GGCCCCTGTGTGTGGAGATACAACTGGCTCCT CGGTGACTCTAGGATGCCTGGTCAAGGGTTAT TTCCCTGAGCCAGTGACCTTGACCTGGAACTCT GGATCCCTGTCCAGTGGTGTGCACACCTTCCCA GCTGTCCTGCAGTCTGACCTCTACACCCTCAGC AGCTCAGTGACTGTAACCTCGAGCACCTGGCC CAGCCAGTCCATCACCTGCAATGTGGCCCACC CGGCAAGCAGCACCAAGGTGGACAAGAAAAT TGAGCCCAGAGGGCCCACAATCAAGCCCTGTC CTCCATGCAAATGCCCAGCACCTAACCTCTTGG GTGGACCATCCGTCTTCATCTTCCCTCCAAAGA TCAAGGATGTACTCATGATCTCCCTGAGCCCCA TAGTCACATGTGTGGTGGTGGATGTGAGCGAG GATGACCCAGATGTCCAGATCAGCTGGTTTGT GAACAACGTGGAAGTACACACAGCTCAGACAC AAACCCATAGAGAGGATTACAACAGTACTCTC CGGGTGGTCAGTGCCCTCCCCATCCAGCACCA GGACTGGATGAGTGGCAAGGAGTTCAAATGCA AGGTCAACAACAAAGACCTCCCAGCGCCCATC GAGAGAACCATCTCAAAACCCAAAGGGTCAGT AAGAGCTCCACAGGTATATGTCTTGCCTCCACC AGAAGAAGAGATGACTAAGAAACAGGTCACT CTGACCTGCATGGTCACAGACTTCATGCCTGA AGACATTTACGTGGAGTGGACCAACAACGGGA AAACAGAGCTAAACTACAAGAACACTGAACCA GTCCTGGACTCTGATGGTTCTTACTTCATGTAC AGCAAGCTGAGAGTGGAAAAGAAGAACTGGG TGGAAAGAAATAGCTACTCCTGTTCAGTGGTC CACGAGGGTCTGCACAATCACCACACGACTAA GAGCTTCTCCCGGACTCCGGGTAAATGA | 1181 |
| SM1B319 | pDR000029283 | ATGGCTTGGGTGTGGACCTTGCTATTCCTGATG GCAGCTGCCCAAAGTATACAGGCCCAGGTGCA GCTGCAGCAGTCTGGCGCCGAGCTGATGAACC CTGGCGCCAGCGTGAAGATCAGCTGCAAGAGC ACCGGCTACAAGTTCAGCAGCTACTGGATCGA GTGGGTCAAGCAGCGGCCTGGCCACGGCCTGG AATGGATGGGCGAGATCCTGCCTGGCAGCGGC AGCACCAACCACAACGAGAAGTTCAAGGGCA AGGCCATCTTCACCGCCGACGCCAGCAGCAAC ACCGCCTACATGGAACTGAGCAGCCTGACCAG CGAGGACAGCGCCGTGTACTACTGCGCCCGGA CCATCAGCACCGCCACCGATTGGTTCGCCTACT GGGGCCAGGGCACCCTGGTCACCGTGTCTGCT GCCAAAACAACAGCACCAAGTGTCTATCCACT GGCCCCTGTGTGTGGAGATACAACTGGCTCCT CGGTGACTCTAGGATGCCTGGTCAAGGGTTAT TTCCCTGAGCCAGTGACCTTGACCTGGAACTCT GGATCCCTGTCCAGTGGTGTGCACACCTTCCCA GCTGTCCTGCAGTCTGACCTCTACACCCTCAGC AGCTCAGTGACTGTAACCTCGAGCACCTGGCC CAGCCAGTCCATCACCTGCAATGTGGCCCACC CGGCAAGCAGCACCAAGGTGGACAAGAAAAT TGAGCCCAGAGGGCCCACAATCAAGCCCTGTC CTCCATGCAAATGCCCAGCACCTAACCTCTTGG GTGGACCATCCGTCTTCATCTTCCCTCCAAAGA TCAAGGATGTACTCATGATCTCCCTGAGCCCCA | 1182 |

TABLE 47-continued

HlgA/LukE Antibody Heavy Chain Primary Transcripts

| mAB/Fab name | Construct ID | Heavy Chain Primary Transcript | SEQ ID NO: |
|---|---|---|---|
| | | TAGTCACATGTGTGGTGGTGGATGTGAGCGAG<br>GATGACCCAGATGTCCAGATCAGCTGGTTTGT<br>GAACAACGTGGAAGTACACACAGCTCAGACAC<br>AAACCCATAGAGAGGATTACAACAGTACTCTC<br>CGGGTGGTCAGTGCCCTCCCCATCCAGCACCA<br>GGACTGGATGAGTGGCAAGGAGTTCAAATGCA<br>AGGTCAACAACAAAGACCTCCCAGCGCCCATC<br>GAGAGAACCATCTCAAAACCCAAAGGGTCAGT<br>AAGAGCTCCACAGGTATATGTCTTGCCTCCACC<br>AGAAGAAGAGATGACTAAGAAACAGGTCACT<br>CTGACCTGCATGGTCACAGACTTCATGCCTGA<br>AGACATTTACGTGGAGTGGACCAACAACGGGA<br>AAACAGAGCTAAACTACAAGAACACTGAACCA<br>GTCCTGGACTCTGATGGTTCTTACTTCATGTAC<br>AGCAAGCTGAGAGTGGAAAAGAAGAACTGGG<br>TGGAAAGAAATAGCTACTCCTGTTCAGTGGTC<br>CACGAGGGTCTGCACAATCACCACACGACTAA<br>GAGCTTCTCCCGGACTCCGGGTAAATGA | |
| SM1B320 | pDR000029282 | ATGGCTTGGGTGTGGACCTTGCTATTCCTGATG<br>GCAGCTGCCCAAAGTATACAGGCCCAGGTGCA<br>GCTGCAGCAGTCTGGCGCCGAGCTGATGAAGC<br>CTGGCGCCAGCGTGAAGATGAGCTGCAAGGCC<br>ACCGGCTACAAGTTCAGCAGCTACTGGATCGA<br>GTGGGTCAAGCAGCGGCCTGGCCACGGCCTGG<br>AATGGATGGGCGAGATCCTGCCTGGCAGCGGC<br>AGCACCAACCACAACGAGAAGTTCAAGGGCA<br>AGGCCATCTTCACCGCCGACGCCAGCAGCAAC<br>ACCGCCTACATGGAACTGAGCAGCCTGACCAG<br>CGAGGACAGCGCCGTGTACTACTGCGCCCGGA<br>CCATCAGCACCGCCACCGATTGGTTCGCCTACT<br>GGGGCCAGGGCACCCTGGTCACCGTGTCTGCT<br>GCCAAAACAACAGCACCAAGTGTCTATCCACT<br>GGCCCCTGTGTGTGGAGATACAACTGGCTCCT<br>CGGTGACTCTAGGATGCCTGGTCAAGGGTTAT<br>TTCCCTGAGCCAGTGACCTTGACCTGGAACTCT<br>GGATCCCTGTCCAGTGGTGTGCACACCTTCCA<br>GCTGTCCTGCAGTCTGACCTCTACACCCTCAGC<br>AGCTCAGTGACTGTAACCTCGAGCACCTGGCC<br>CAGCCAGTCCATCACCTGCAATGTGGCCCACC<br>CGGCAAGCAGCACCAAGGTGGACAAGAAAAT<br>TGAGCCCAGAGGGCCCACAATCAAGCCCTGTC<br>CTCCATGCAAATGCCCAGCACCTAACCTCTTGG<br>GTGGACCATCCGTCTTCATCTTCCCTCCAAAGA<br>TCAAGGATGTACTCATGATCTCCCTGAGCCCCA<br>TAGTCACATGTGTGGTGGTGGATGTGAGCGAG<br>GATGACCCAGATGTCCAGATCAGCTGGTTTGT<br>GAACAACGTGGAAGTACACACAGCTCAGACAC<br>AAACCCATAGAGAGGATTACAACAGTACTCTC<br>CGGGTGGTCAGTGCCCTCCCCATCCAGCACCA<br>GGACTGGATGAGTGGCAAGGAGTTCAAATGCA<br>AGGTCAACAACAAAGACCTCCCAGCGCCCATC<br>GAGAGAACCATCTCAAAACCCAAAGGGTCAGT<br>AAGAGCTCCACAGGTATATGTCTTGCCTCCACC<br>AGAAGAAGAGATGACTAAGAAACAGGTCACT<br>CTGACCTGCATGGTCACAGACTTCATGCCTGA<br>AGACATTTACGTGGAGTGGACCAACAACGGGA<br>AAACAGAGCTAAACTACAAGAACACTGAACCA<br>GTCCTGGACTCTGATGGTTCTTACTTCATGTAC<br>AGCAAGCTGAGAGTGGAAAAGAAGAACTGGG<br>TGGAAAGAAATAGCTACTCCTGTTCAGTGGTC<br>CACGAGGGTCTGCACAATCACCACACGACTAA<br>GAGCTTCTCCCGGACTCCGGGTAAATGA | 1183 |
| SM1B321 | pDR000029281 | ATGGCTTGGGTGTGGACCTTGCTATTCCTGATG<br>GCAGCTGCCCAAAGTATACAGGCCCAGGTGCA<br>GCTGCAGCAGTCTGGCGCCGAGCTGATGAAGC<br>CTGGCGCCAGCGTGAAGATGAGCTGCAAGGCC<br>ACCGGCTACAAGTTCAGCAGCTACTGGATCGA<br>GTGGGTCAAGCAGCGGCCTGGCCACGGCCTGG<br>AATGGATGGGCGAGATCCTGCCTGGCAGCGGC<br>AGCACCAACCACAACGAGAAGTTCACCGGCAG<br>AGCCATCTTCACCGCCGACGCCAGCAGCAACA<br>CCGCCTACATGGAACTGAGCAGCCTGACCAGC<br>GAGGACAGCGCCGTGTACTACTGCGCCCGGAC | 1184 |

TABLE 47-continued

HlgA/LukE Antibody Heavy Chain Primary Transcripts

| mAB/Fab name | Construct ID | Heavy Chain Primary Transcript | SEQ ID NO: |
|---|---|---|---|
| | | CATCAGCACCGCCACCGATTGGTTCGCCTACTG<br>GGGCCAGGGCACCCTGGTCACCGTGTCTGCTG<br>CCAAAACAACAGCACCAAGTGTCTATCCACTG<br>GCCCCTGTGTGTGGAGATACAACTGGCTCCTC<br>GGTGACTCTAGGATGCCTGGTCAAGGGTTATTT<br>CCCTGAGCCAGTGACCTTGACCTGGAACTCTG<br>GATCCCTGTCCAGTGGTGTGCACACCTTCCCAG<br>CTGTCCTGCAGTCTGACCTCTACACCCTCAGCA<br>GCTCAGTGACTGTAACCTCGAGCACCTGGCCC<br>AGCCAGTCCATCACCTGCAATGTGGCCCACCC<br>GGCAAGCAGCACCAAGGTGGACAAGAAAATT<br>GAGCCCAGAGGGCCCACAATCAAGCCCTGTCC<br>TCCATGCAAATGCCCAGCACCTAACCTCTTGG<br>GTGGACCATCCGTCTTCATCTTCCCTCCAAAGA<br>TCAAGGATGTACTCATGATCTCCCTGAGCCCCA<br>TAGTCACATGTGTGGTGGTGGATGTGAGCGAG<br>GATGACCCAGATGTCCAGATCAGCTGGTTTGT<br>GAACAACGTGGAAGTACACACAGCTCAGACAC<br>AAACCCATAGAGAGGATTACAACAGTACTCTC<br>CGGGTGGTCAGTGCCCTCCCCATCCAGCACCA<br>GGACTGGATGAGTGGCAAGGAGTTCAAATGCA<br>AGGTCAACAACAAAGACCTCCCAGCGCCCATC<br>GAGAGAACCATCTCAAAACCCAAAGGGTCAGT<br>AAGAGCTCCACAGGTATATGTCTTGCCTCCACC<br>AGAAGAAGAGATGACTAAGAAACAGGTCACT<br>CTGACCTGCATGGTCACAGACTTCATGCCTGA<br>AGACATTTACGTGGAGTGGACCAACAACGGGA<br>AAACAGAGCTAAACTACAAGAACACTGAACCA<br>GTCCTGGACTCTGATGGTTCTTACTTCATGTAC<br>AGCAAGCTGAGAGTGGAAAAGAAGAACTGGG<br>TGGAAAGAAATAGCTACTCCTGTTCAGTGGTC<br>CACGAGGGTCTGCACAATCACCACACGACTAA<br>GAGCTTCTCCCGGACTCCGGGTAAATGA | |
| SM1B322 | pDR000029282 | ATGGCTTGGGTGTGGACCTTGCTATTCCTGATG<br>GCAGCTGCCCAAAGTATACAGGCCCAGGTGCA<br>GCTGCAGCAGTCTGGCGCCGAGCTGATGAAGC<br>CTGGCGCCAGCGTGAAGATGAGCTGCAAGGCC<br>ACCGGCTACAAGTTCAGCAGCTACTGGATCGA<br>GTGGGTCAAGCAGCGGCCTGGCCACGGCCTGG<br>AATGGATGGGCGAGATCCTGCCTGGCAGCGGC<br>AGCACCAACCACAACGAGAAGTTCAAGGGCA<br>AGGCCATCTTCACCGCCGACGCCAGCAGCAAC<br>ACCGCCTACATGGAACTGAGCAGCCTGACCAG<br>CGAGGACAGCGCCGTGTACTACTGCGCCCGGA<br>CCATCAGCACCGCCACCGATTGGTTCGCCTACT<br>GGGGCCAGGGCACCCTGGTCACCGTGTCTGCT<br>GCCAAAACAACAGCACCAAGTGTCTATCCACT<br>GGCCCCTGTGTGTGGAGATACAACTGGCTCCT<br>CGGTGACTCTAGGATGCCTGGTCAAGGGTTAT<br>TTCCCTGAGCCAGTGACCTTGACCTGGAACTCT<br>GGATCCCTGTCCAGTGGTGTGCACACCTTCCCA<br>GCTGTCCTGCAGTCTGACCTCTACACCCTCAGC<br>AGCTCAGTGACTGTAACCTCGAGCACCTGGCC<br>CAGCCAGTCCATCACCTGCAATGTGGCCCACC<br>CGGCAAGCAGCACCAAGGTGGACAAGAAAAT<br>TGAGCCCAGAGGGCCCACAATCAAGCCCTGTC<br>CTCCATGCAAATGCCCAGCACCTAACCTCTTGG<br>GTGGACCATCCGTCTTCATCTTCCCTCCAAAGA<br>TCAAGGATGTACTCATGATCTCCCTGAGCCCCA<br>TAGTCACATGTGTGGTGGTGGATGTGAGCGAG<br>GATGACCCAGATGTCCAGATCAGCTGGTTTGT<br>GAACAACGTGGAAGTACACACAGCTCAGACAC<br>AAACCCATAGAGAGGATTACAACAGTACTCTC<br>CGGGTGGTCAGTGCCCTCCCCATCCAGCACCA<br>GGACTGGATGAGTGGCAAGGAGTTCAAATGCA<br>AGGTCAACAACAAAGACCTCCCAGCGCCCATC<br>GAGAGAACCATCTCAAAACCCAAAGGGTCAGT<br>AAGAGCTCCACAGGTATATGTCTTGCCTCCACC<br>AGAAGAAGAGATGACTAAGAAACAGGTCACT<br>CTGACCTGCATGGTCACAGACTTCATGCCTGA<br>AGACATTTACGTGGAGTGGACCAACAACGGGA<br>AAACAGAGCTAAACTACAAGAACACTGAACCA<br>GTCCTGGACTCTGATGGTTCTTACTTCATGTAC<br>AGCAAGCTGAGAGTGGAAAAGAAGAACTGGG | 1185 |

TABLE 47-continued

HlgA/LukE Antibody Heavy Chain Primary Transcripts

| mAB/Fab name | Construct ID | Heavy Chain Primary Transcript | SEQ ID NO: |
|---|---|---|---|
| | | TGGAAAGAAATAGCTACTCCTGTTCAGTGGTC CACGAGGGTCTGCACAATCACCACACGACTAA GAGCTTCTCCCGGACTCCGGGTAAATGA | |
| SM1B323 | pDR000029280 | ATGGCTTGGGTGTGGACCTTGCTATTCCTGATG GCAGCTGCCCAAAGTATACAGGCCCAGGTGCA GCTGCAGCAGTCTGGCGCCGAGCTGATGAAGC CTGGCGCCAGCGTGAAGATGCCCTGCAAGGCC ACCGGCTACAAGTTCAGCAGCTACTGGATCGA GTGGGTCAAGCAGCGGCCTGGCCACGGCCTGG AATGGATGGGCGAGATCCTGCCTGGCAGCGGC AGCACCAACCACAACGAGAAGTTCAAGGGCA AGGCCATCTTCACCGCCGACGCCAGCAGCAAC ACCGCCTACATGGAACTGAGCAGCCTGACCAG CGAGGACAGCGCCGTGTACTACTGCGCCCGGA CCATCAGCACCGCCACCGATTGGTTCGCCTACT GGGGCCAGGGCACCCTGGTCACCGTGTCTGCT GCCAAAACAACAGCACCAAGTGTCTATCCACT GGCCCCTGTGTGTGGAGATACAACTGGCTCCT CGGTGACTCTAGGATGCCTGGTCAAGGGTTAT TTCCCTGAGCCAGTGACCTTGACCTGGAACTCT GGATCCCTGTCCAGTGGTGTGCACACCTTCCCA GCTGTCCTGCAGTCTGACCTCTACACCCTCAGC AGCTCAGTGACTGTAACCTCGAGCACCTGGCC CAGCCAGTCCATCACCTGCAATGTGGCCCACC CGGCAAGCAGCACCAAGGTGGACAAGAAAAT TGAGCCCAGAGGGCCCACAATCAAGCCCTGTC CTCCATGCAAATGCCCAGCACCTAACCTCTTGG GTGGACCATCCGTCTTCATCTTCCCTCCAAAGA TCAAGGATGTACTCATGATCTCCCTGAGCCCCA TAGTCACATGTGTGGTGGTGGATGTGAGCGAG GATGACCCAGATGTCCAGATCAGCTGGTTTGT GAACAACGTGGAAGTACACACAGCTCAGACAC AAACCCATAGAGAGGATTACAACAGTACTCTC CGGGTGGTCAGTGCCCTCCCCATCCAGCACCA GGACTGGATGAGTGGCAAGGAGTTCAAATGCA AGGTCAACAACAAAGACCTCCCAGCGCCCATC GAGAGAACCATCTCAAAACCCAAAGGGTCAGT AAGAGCTCCACAGGTATATGTCTTGCCTCCACC AGAAGAAGAGATGACTAAGAAACAGGTCACT CTGACCTGCATGGTCACAGACTTCATGCCTGA AGACATTTACGTGGAGTGGACCAACAACGGGA AAACAGAGCTAAACTACAAGAACACTGAACCA GTCCTGGACTCTGATGGTTCTTACTTCATGTAC AGCAAGCTGAGAGTGGAAAAGAAGAACTGGG TGGAAAGAAATAGCTACTCCTGTTCAGTGGTC CACGAGGGTCTGCACAATCACCACACGACTAA GAGCTTCTCCCGGACTCCGGGTAAATGA | 1186 |
| SM1B324 | pDR000029279 | ATGGCTTGGGTGTGGACCTTGCTATTCCTGATG GCAGCTGCCCAAAGTATACAGGCCGAGGTGCA GCTGCAGCAGTCTGGCGCTGAACTCGTGCGGC CTGGCGCCCTGGTCAAGCTGAGCTGCAAGGCC AGCGGCTTCAACATCAAGGACTACTACATGCA CTGGGTCAAGCAGCGGCCCGAGCAGGGCCTGG AATGGATCGGCTGGATCGACCCCGAGAACGGC AACACCATCTACGACCCCAAGTTCCAGGGCAA GGCCTCCATCACCGCCGACACCAGCAGCAACA CCGCCTACCTGCAGCTGAGCAGCCTGACCAGC GAGGACACCGCCGTGTACTACTGCGCCAGATA CGACGGCTACGCCATGGACTACTGGGGCCAGG GCACCAGCGTGACCGTGTCCTCTGCCAAAACA ACAGCACCAAGTGTCTATCCACTGGCCCCTGT GTGTGGAGATACAACTGGCTCCTCGGTGACTC TAGGATGCCTGGTCAAGGGTTATTTCCCTGAGC CAGTGACCTTGACCTGGAACTCTGGATCCCTGT CCAGTGGTGTGCACACCTTCCCAGCTGTCCTGC AGTCTGACCTCTACACCCTCAGCAGCTCAGTG ACTGTAACCTCGAGCACCTGGCCCAGCCAGTC CATCACCTGCAATGTGGCCCACCCGGCAAGCA GCACCAAGGTGGACAAGAAAATTGAGCCCAG AGGGCCCACAATCAAGCCCTGTCCTCCATGCA AATGCCCAGCACCTAACCTCTTGGGTGGACCA TCCGTCTTCATCTTCCCTCCAAAGATCAAGGAT GTACTCATGATCTCCCTGAGCCCCATAGTCACA | 1187 |

TABLE 47-continued

HlgA/LukE Antibody Heavy Chain Primary Transcripts

| mAB/Fab name | Construct ID | Heavy Chain Primary Transcript | SEQ ID NO: |
|---|---|---|---|
| | | TGTGTGGTGGTGGATGTGAGCGAGGATGACCC<br>AGATGTCCAGATCAGCTGGTTTGTGAACAACG<br>TGGAAGTACACACAGCTCAGACACAAACCCAT<br>AGAGAGGATTACAACAGTACTCTCCGGGTGGT<br>CAGTGCCCTCCCCATCCAGCACCAGGACTGGA<br>TGAGTGGCAAGGAGTTCAAATGCAAGGTCAAC<br>AACAAAGACCTCCCAGCGCCCATCGAGAGAAC<br>CATCTCAAAACCCAAAGGGTCAGTAAGAGCTC<br>CACAGGTATATGTCTTGCCTCCACCAGAAGAA<br>GAGATGACTAAGAAACAGGTCACTCTGACCTG<br>CATGGTCACAGACTTCATGCCTGAAGACATTT<br>ACGTGGAGTGGACCAACAACGGGAAAACAGA<br>GCTAAACTACAAGAACACTGAACCAGTCCTGG<br>ACTCTGATGGTTCTTACTTCATGTACAGCAAGC<br>TGAGAGTGGAAAAGAAGAACTGGGTGGAAAG<br>AAATAGCTACTCCTGTTCAGTGGTCCACGAGG<br>GTCTGCACAATCACCACACGACTAAGAGCTTC<br>TCCCGGACTCCGGGTAAATGA | |
| SM1B325 | pDR000029278 | ATGGCTTGGGTGTGGACCTTGCTATTCCTGATG<br>GCAGCTGCCCAAAGTATACAGGCCCAGGTGCA<br>GCTGCAGCAGTCTGGCGCTGAACTCGTGCGGC<br>CTGGCACCAGCGTGAAGATGAGCTGCAAGGCC<br>GCTGGCTACACCTTCACCAACTACTGGATCGG<br>CTGGGTCAAGCAGCGGCCTGGCCACGGCCTGG<br>AATGGATCGGCGACATCTACCCTGGCGGCGGA<br>TACACCAACTACAACGAGAAGTTCAAGGACAA<br>GACCACCCTGACCGCCGACACCAGCAGCAACA<br>CCGCCTACATGCAGCTGAGCAGCCTGACCAGC<br>GAGGACAGCGCCATCTACTACTGCGCCAGCAA<br>CGACTGCTGGGGCCAGGGCACCACACTGACCG<br>TGTCCAGCGCCAAAACAACAGCACCAAGTGTC<br>TATCCACTGGCCCCTGTGTGTGGAGATACAACT<br>GGCTCCTCGGTGACTCTAGGATGCCTGGTCAA<br>GGGTTATTTCCCTGAGCCAGTGACCTTGACCTG<br>GAACTCTGGATCCCTGTCCAGTGGTGTGCACA<br>CCTTCCCAGCTGTCCTGCAGTCTGACCTCTACA<br>CCCTCAGCAGCTCAGTGACTGTAACCTCGAGC<br>ACCTGGCCCAGCCAGTCCATCACCTGCAATGT<br>GGCCCACCCGGCAAGCAGCACCAAGGTGGACA<br>AGAAAATTGAGCCCAGAGGGCCCACAATCAAG<br>CCCTGTCCTCCATGCAAATGCCCAGCACCTAAC<br>CTCTTGGGTGGACCATCCGTCTTCATCTTCCCT<br>CCAAAGATCAAGGATGTACTCATGATCTCCCT<br>GAGCCCCATAGTCACATGTGTGGTGGTGGATG<br>TGAGCGAGGATGACCCAGATGTCCAGATCAGC<br>TGGTTTGTGAACAACGTGGAAGTACACACAGC<br>TCAGACACAAACCCATAGAGAGGATTACAACA<br>GTACTCTCCGGGTGGTCAGTGCCCTCCCCATCC<br>AGCACCAGGACTGGATGAGTGGCAAGGAGTTC<br>AAATGCAAGGTCAACAACAAAGACCTCCCAGC<br>GCCCATCGAGAGAACCATCTCAAAACCCAAAG<br>GGTCAGTAAGAGCTCCACAGGTATATGTCTTG<br>CCTCCACCAGAAGAAGAGATGACTAAGAAACA<br>GGTCACTCTGACCTGCATGGTCACAGACTTCAT<br>GCCTGAAGACATTTACGTGGAGTGGACCAACA<br>ACGGGAAAACAGAGCTAAACTACAAGAACAC<br>TGAACCAGTCCTGGACTCTGATGGTTCTTACTT<br>CATGTACAGCAAGCTGAGAGTGGAAAAGAAG<br>AACTGGGTGGAAAGAAATAGCTACTCCTGTTC<br>AGTGGTCCACGAGGGTCTGCACAATCACCACA<br>CGACTAAGAGCTTCTCCCGGACTCCGGGTAAA<br>TGA | 1188 |
| SM1B326 | pDR000029277 | ATGGCTTGGGTGTGGACCTTGCTATTCCTGATG<br>GCAGCTGCCCAAAGTATACAGGCCCAGGTGCA<br>GCTGAAGCAGAGCGGCCCTGGCCTGGTGCAGC<br>CTAGCCAGAGCCTGAGCATCACCTGTACCGTG<br>TCCGGCTTCAGCATCACCAGCTACGGCGTGCA<br>CTGGATCCGGCAGAGCCCCGGCAAGGGCCTGG<br>AATGGCTGGGAGTGATTTGGAGCGGCGGCAGC<br>ACCGACTACAACGCCGCCTTCATCAGCAGACT<br>GAGCATCAGCGAGGACAACAGCAAGAGCCAG<br>GTGTTCTTCAAGATGAACAGCCTGCAGGCCAA<br>CGACACCGCCATCTACTACTGCGCCACCTTCTA | 1189 |

TABLE 47-continued

HlgA/LukE Antibody Heavy Chain Primary Transcripts

| mAB/Fab name | Construct ID | Heavy Chain Primary Transcript | SEQ ID NO: |
|---|---|---|---|
| | | CTACGACTACGACGAGGGCTTCGACTACTGGG GCCAGGGCACCACCCTGACCGTGTCCTCTGCC AAAACAACAGCACCAAGTGTCTATCCACTGGC CCCTGTGTGTGGAGATACAACTGGCTCCTCGGT GACTCTAGGATGCCTGGTCAAGGGTTATTTCCC TGAGCCAGTGACCTTGACCTGGAACTCTGGAT CCCTGTCCAGTGGTGTGCACACCTTCCCAGCTG TCCTGCAGTCTGACCTCTACACCCTCAGCAGCT CAGTGACTGTAACCTCGAGCACCTGGCCCAGC CAGTCCATCACCTGCAATGTGGCCCACCCGGC AAGCAGCACCAAGGTGGACAAGAAAATTGAG CCCAGAGGGCCCACAATCAAGCCCTGTCCTCC ATGCAAATGCCCAGCACCTAACCTCTTGGGTG GACCATCCGTCTTCATCTTCCCTCCAAAGATCA AGGATGTACTCATGATCTCCCTGAGCCCCATA GTCACATGTGTGGTGGTGGATGTGAGCGAGGA TGACCCAGATGTCCAGATCAGCTGGTTTGTGA ACAACGTGGAAGTACACACAGCTCAGACACAA ACCCATAGAGAGGATTACAACAGTACTCTCCG GGTGGTCAGTGCCCTCCCCATCCAGCACCAGG ACTGGATGAGTGGCAAGGAGTTCAAATGCAAG GTCAACAACAAAGACCTCCCAGCGCCCATCGA GAGAACCATCTCAAAACCCAAAGGGTCAGTAA GAGCTCCACAGGTATATGTCTTGCCTCCACCAG AAGAAGAGATGACTAAGAAACAGGTCACTCTG ACCTGCATGGTCACAGACTTCATGCCTGAAGA CATTTACGTGGAGTGGACCAACAACGGGAAAA CAGAGCTAAACTACAAGAACACTGAACCAGTC CTGGACTCTGATGGTTCTTACTTCATGTACAGC AAGCTGAGAGTGGAAAAGAAGAACTGGGTGG AAAGAAATAGCTACTCCTGTTCAGTGGTCCAC GAGGGTCTGCACAATCACCACACGACTAAGAG CTTCTCCCGGACTCCGGGTAAATGA | |
| SM1B327 | pDR000029276 | ATGGCTTGGGTGTGGACCTTGCTATTCCTGATG GCAGCTGCCCAAAGTATACAGGCCCAGGTGCA GCTGAAGCAGAGCGGCCCTGGCCTGGTGCAGC CTAGCCAGAGCCTGAGCATCACCTGTACCGTG TCCGGCTTCAGCATCACCAGCTACGGCGTGCA CTGGATCCGGCAGAGCCCCGGCAAGGGCCTGG AATGGCTGGGAGTGATTTGGAGCGGCGGCAGC ACCGACTACAACGCCGCCTTCATCAGCAGACT GAGCATCAGCAAGGACAACAGCAAGAGCCAG GTGTTCTTCAAGATGAACAGCCTGCAGGCCAA CGACACCGCCATCTACTACTGCGCCACCTTCTA CTACGACTACGACGAGGGCTTCGACTACTGGG GCCAGGGCACCACCCTGACCGTGTCCTCTGCC AAAACAACAGCACCAAGTGTCTATCCACTGGC CCCTGTGTGTGGAGATACAACTGGCTCCTCGGT GACTCTAGGATGCCTGGTCAAGGGTTATTTCCC TGAGCCAGTGACCTTGACCTGGAACTCTGGAT CCCTGTCCAGTGGTGTGCACACCTTCCCAGCTG TCCTGCAGTCTGACCTCTACACCCTCAGCAGCT CAGTGACTGTAACCTCGAGCACCTGGCCCAGC CAGTCCATCACCTGCAATGTGGCCCACCCGGC AAGCAGCACCAAGGTGGACAAGAAAATTGAG CCCAGAGGGCCCACAATCAAGCCCTGTCCTCC ATGCAAATGCCCAGCACCTAACCTCTTGGGTG GACCATCCGTCTTCATCTTCCCTCCAAAGATCA AGGATGTACTCATGATCTCCCTGAGCCCCATA GTCACATGTGTGGTGGTGGATGTGAGCGAGGA TGACCCAGATGTCCAGATCAGCTGGTTTGTGA ACAACGTGGAAGTACACACAGCTCAGACACAA ACCCATAGAGAGGATTACAACAGTACTCTCCG GGTGGTCAGTGCCCTCCCCATCCAGCACCAGG ACTGGATGAGTGGCAAGGAGTTCAAATGCAAG GTCAACAACAAAGACCTCCCAGCGCCCATCGA GAGAACCATCTCAAAACCCAAAGGGTCAGTAA GAGCTCCACAGGTATATGTCTTGCCTCCACCAG AAGAAGAGATGACTAAGAAACAGGTCACTCTG ACCTGCATGGTCACAGACTTCATGCCTGAAGA CATTTACGTGGAGTGGACCAACAACGGGAAAA CAGAGCTAAACTACAAGAACACTGAACCAGTC CTGGACTCTGATGGTTCTTACTTCATGTACAGC AAGCTGAGAGTGGAAAAGAAGAACTGGGTGG | 1190 |

TABLE 47-continued

HlgA/LukE Antibody Heavy Chain Primary Transcripts

| mAB/Fab name | Construct ID | Heavy Chain Primary Transcript | SEQ ID NO: |
|---|---|---|---|
| | | AAAGAAATAGCTACTCCTGTTCAGTGGTCCAC<br>GAGGGTCTGCACAATCACCACACGACTAAGAG<br>CTTCTCCCGGACTCCGGGTAAATGA | |
| SM1B328 | pDR000029276 | ATGGCTTGGGTGTGGACCTTGCTATTCCTGATG<br>GCAGCTGCCCAAAGTATACAGGCCCAGGTGCA<br>GCTGAAGCAGAGCGGCCCTGGCCTGGTGCAGC<br>CTAGCCAGAGCCTGAGCATCACCTGTACCGTG<br>TCCGGCTTCAGCATCACCAGCTACGGCGTGCA<br>CTGGATCCGGCAGAGCCCCGGCAAGGGCCTGG<br>AATGGCTGGGAGTGATTTGGAGCGGCGGCAGC<br>ACCGACTACAACGCCGCCTTCATCAGCAGACT<br>GAGCATCAGCAAGGACAACAGCAAGAGCCAG<br>GTGTTCTTCAAGATGAACAGCCTGCAGGCCAA<br>CGACACCGCCATCTACTACTGCGCCACCTTCTA<br>CTACGACTACGACGAGGGCTTCGACTACTGGG<br>GCCAGGGCACCACCCTGACCGTGTCCTCTGCC<br>AAAACAACAGCACCAAGTGTCTATCCACTGGC<br>CCCTGTGTGTGGAGATACAACTGGCTCCTCGGT<br>GACTCTAGGATGCCTGGTCAAGGGTTATTTCCC<br>TGAGCCAGTGACCTTGACCTGGAACTCTGGAT<br>CCCTGTCCAGTGGTGTGCACACCTTCCCAGCTG<br>TCCTGCAGTCTGACCTCTACACCCTCAGCAGCT<br>CAGTGACTGTAACCTCGAGCACCTGGCCCAGC<br>CAGTCCATCACCTGCAATGTGGCCCACCCGGC<br>AAGCAGCACCAAGGTGGACAAGAAAATTGAG<br>CCCAGAGGGCCCACAATCAAGCCCTGTCCTCC<br>ATGCAAATGCCCAGCACCTAACCTCTTGGGTG<br>GACCATCCGTCTTCATCTTCCCTCCAAAGATCA<br>AGGATGTACTCATGATCTCCCTGAGCCCCATA<br>GTCACATGTGTGGTGGTGGATGTGAGCGAGGA<br>TGACCCAGATGTCCAGATCAGCTGGTTTGTGA<br>ACAACGTGGAAGTACACACAGCTCAGACACAA<br>ACCCATAGAGAGGATTACAACAGTACTCTCCG<br>GGTGGTCAGTGCCCTCCCCATCCAGCACCAGG<br>ACTGGATGAGTGGCAAGGAGTTCAAATGCAAG<br>GTCAACAACAAAGACCTCCCAGCGCCCATCGA<br>GAGAACCATCTCAAAACCCAAAGGGTCAGTAA<br>GAGCTCCACAGGTATATGTCTTGCCTCCACCAG<br>AAGAAGAGATGACTAAGAAACAGGTCACTCTG<br>ACCTGCATGGTCACAGACTTCATGCCTGAAGA<br>CATTTACGTGGAGTGGACCAACAACGGGAAAA<br>CAGAGCTAAACTACAAGAACACTGAACCAGTC<br>CTGGACTCTGATGGTTCTTACTTCATGTACAGC<br>AAGCTGAGAGTGGAAAAGAAGAACTGGGTGG<br>AAAGAAATAGCTACTCCTGTTCAGTGGTCCAC<br>GAGGGTCTGCACAATCACCACACGACTAAGAG<br>CTTCTCCCGGACTCCGGGTAAATGA | 1191 |
| SM1B329 | pDR000029276 | ATGGCTTGGGTGTGGACCTTGCTATTCCTGATG<br>GCAGCTGCCCAAAGTATACAGGCCCAGGTGCA<br>GCTGAAGCAGAGCGGCCCTGGCCTGGTGCAGC<br>CTAGCCAGAGCCTGAGCATCACCTGTACCGTG<br>TCCGGCTTCAGCATCACCAGCTACGGCGTGCA<br>CTGGATCCGGCAGAGCCCCGGCAAGGGCCTGG<br>AATGGCTGGGAGTGATTTGGAGCGGCGGCAGC<br>ACCGACTACAACGCCGCCTTCATCAGCAGACT<br>GAGCATCAGCAAGGACAACAGCAAGAGCCAG<br>GTGTTCTTCAAGATGAACAGCCTGCAGGCCAA<br>CGACACCGCCATCTACTACTGCGCCACCTTCTA<br>CTACGACTACGACGAGGGCTTCGACTACTGGG<br>GCCAGGGCACCACCCTGACCGTGTCCTCTGCC<br>AAAACAACAGCACCAAGTGTCTATCCACTGGC<br>CCCTGTGTGTGGAGATACAACTGGCTCCTCGGT<br>GACTCTAGGATGCCTGGTCAAGGGTTATTTCCC<br>TGAGCCAGTGACCTTGACCTGGAACTCTGGAT<br>CCCTGTCCAGTGGTGTGCACACCTTCCCAGCTG<br>TCCTGCAGTCTGACCTCTACACCCTCAGCAGCT<br>CAGTGACTGTAACCTCGAGCACCTGGCCCAGC<br>CAGTCCATCACCTGCAATGTGGCCCACCCGGC<br>AAGCAGCACCAAGGTGGACAAGAAAATTGAG<br>CCCAGAGGGCCCACAATCAAGCCCTGTCCTCC<br>ATGCAAATGCCCAGCACCTAACCTCTTGGGTG<br>GACCATCCGTCTTCATCTTCCCTCCAAAGATCA<br>AGGATGTACTCATGATCTCCCTGAGCCCCATA | 1192 |

TABLE 47-continued

HlgA/LukE Antibody Heavy Chain Primary Transcripts

| mAB/Fab name | Construct ID | Heavy Chain Primary Transcript | SEQ ID NO: |
|---|---|---|---|
| | | GTCACATGTGTGGTGGTGGATGTGAGCGAGGA<br>TGACCCAGATGTCCAGATCAGCTGGTTTGTGA<br>ACAACGTGGAAGTACACACAGCTCAGACACAA<br>ACCCATAGAGAGGATTACAACAGTACTCTCCG<br>GGTGGTCAGTGCCCTCCCCATCCAGCACCAGG<br>ACTGGATGAGTGGCAAGGAGTTCAAATGCAAG<br>GTCAACAACAAAGACCTCCCAGCGCCCATCGA<br>GAGAACCATCTCAAAACCCAAAGGGTCAGTAA<br>GAGCTCCACAGGTATATGTCTTGCCTCCACCAG<br>AAGAAGAGATGACTAAGAAACAGGTCACTCTG<br>ACCTGCATGGTCACAGACTTCATGCCTGAAGA<br>CATTTACGTGGAGTGGACCAACAACGGGAAAA<br>CAGAGCTAAACTACAAGAACACTGAACCAGTC<br>CTGGACTCTGATGGTTCTTACTTCATGTACAGC<br>AAGCTGAGAGTGGAAAAGAAGAACTGGGTGG<br>AAAGAAATAGCTACTCCTGTTCAGTGGTCCAC<br>GAGGGTCTGCACAATCACCACACGACTAAGAG<br>CTTCTCCCGGACTCCGGGTAAATGA | |
| SM1B330 | pDR000029276 | ATGGCTTGGGTGTGGACCTTGCTATTCCTGATG<br>GCAGCTGCCCAAAGTATACAGGCCCAGGTGCA<br>GCTGAAGCAGAGCGGCCCTGGCCTGGTGCAGC<br>CTAGCCAGAGCCTGAGCATCACCTGTACCGTG<br>TCCGGCTTCAGCATCACCAGCTACGGCGTGCA<br>CTGGATCCGGCAGAGCCCCGGCAAGGGCCTGG<br>AATGGCTGGGAGTGATTTGGAGCGGCGGCAGC<br>ACCGACTACAACGCCGCCTTCATCAGCAGACT<br>GAGCATCAGCAAGGACAACAGCAAGAGCCAG<br>GTGTTCTTCAAGATGAACAGCCTGCAGGCCAA<br>CGACACCGCCATCTACTACTGCGCCACCTTCTA<br>CTACGACTACGACGAGGGCTTCGACTACTGGG<br>GCCAGGGCACCACCCTGACCGTGTCCTCTGCC<br>AAAACAACAGCACCAAGTGTCTATCCACTGGC<br>CCCTGTGTGTGGAGATACAACTGGCTCCTCGGT<br>GACTCTAGGATGCCTGGTCAAGGGTTATTTCCC<br>TGAGCCAGTGACCTTGACCTGGAACTCTGGAT<br>CCCTGTCCAGTGGTGTGCACACCTTCCCAGCTG<br>TCCTGCAGTCTGACCTCTACACCCTCAGCAGCT<br>CAGTGACTGTAACCTCGAGCACCTGGCCCAGC<br>CAGTCCATCACCTGCAATGTGGCCCACCCGGC<br>AAGCAGCACCAAGGTGGACAAGAAAATTGAG<br>CCCAGAGGGCCCACAATCAAGCCCTGTCCTCC<br>ATGCAAATGCCCAGCACCTAACCTCTTGGGTG<br>GACCATCCGTCTTCATCTTCCCTCCAAAGATCA<br>AGGATGTACTCATGATCTCCCTGAGCCCCATA<br>GTCACATGTGTGGTGGTGGATGTGAGCGAGGA<br>TGACCCAGATGTCCAGATCAGCTGGTTTGTGA<br>ACAACGTGGAAGTACACACAGCTCAGACACAA<br>ACCCATAGAGAGGATTACAACAGTACTCTCCG<br>GGTGGTCAGTGCCCTCCCCATCCAGCACCAGG<br>ACTGGATGAGTGGCAAGGAGTTCAAATGCAAG<br>GTCAACAACAAAGACCTCCCAGCGCCCATCGA<br>GAGAACCATCTCAAAACCCAAAGGGTCAGTAA<br>GAGCTCCACAGGTATATGTCTTGCCTCCACCAG<br>AAGAAGAGATGACTAAGAAACAGGTCACTCTG<br>ACCTGCATGGTCACAGACTTCATGCCTGAAGA<br>CATTTACGTGGAGTGGACCAACAACGGGAAAA<br>CAGAGCTAAACTACAAGAACACTGAACCAGTC<br>CTGGACTCTGATGGTTCTTACTTCATGTACAGC<br>AAGCTGAGAGTGGAAAAGAAGAACTGGGTGG<br>AAAGAAATAGCTACTCCTGTTCAGTGGTCCAC<br>GAGGGTCTGCACAATCACCACACGACTAAGAG<br>CTTCTCCCGGACTCCGGGTAAATGA | 1193 |
| SM1B331 | pDR000029276 | ATGGCTTGGGTGTGGACCTTGCTATTCCTGATG<br>GCAGCTGCCCAAAGTATACAGGCCCAGGTGCA<br>GCTGAAGCAGAGCGGCCCTGGCCTGGTGCAGC<br>CTAGCCAGAGCCTGAGCATCACCTGTACCGTG<br>TCCGGCTTCAGCATCACCAGCTACGGCGTGCA<br>CTGGATCCGGCAGAGCCCCGGCAAGGGCCTGG<br>AATGGCTGGGAGTGATTTGGAGCGGCGGCAGC<br>ACCGACTACAACGCCGCCTTCATCAGCAGACT<br>GAGCATCAGCAAGGACAACAGCAAGAGCCAG<br>GTGTTCTTCAAGATGAACAGCCTGCAGGCCAA<br>CGACACCGCCATCTACTACTGCGCCACCTTCTA | 1194 |

TABLE 47-continued

HlgA/LukE Antibody Heavy Chain Primary Transcripts

| mAB/Fab name | Construct ID | Heavy Chain Primary Transcript | SEQ ID NO: |
|---|---|---|---|
| | | CTACGACTACGACGAGGGCTTCGACTACTGGG GCCAGGGCACCACCCTGACCGTGTCCTCTGCC AAAACAACAGCACCAAGTGTCTATCCACTGGC CCCTGTGTGTGGAGATACAACTGGCTCCTCGGT GACTCTAGGATGCCTGGTCAAGGGTTATTTCCC TGAGCCAGTGACCTTGACCTGGAACTCTGGAT CCCTGTCCAGTGGTGTGCACACCTTCCCAGCTG TCCTGCAGTCTGACCTCTACACCCTCAGCAGCT CAGTGACTGTAACCTCGAGCACCTGGCCCAGC CAGTCCATCACCTGCAATGTGGCCCACCCGGC AAGCAGCACCAAGGTGGACAAGAAAATTGAG CCCAGAGGGCCCACAATCAAGCCCTGTCCTCC ATGCAAATGCCCAGCACCTAACCTCTTGGGTG GACCATCCGTCTTCATCTTCCCTCCAAAGATCA AGGATGTACTCATGATCTCCCTGAGCCCCATA GTCACATGTGTGGTGGTGGATGTGAGCGAGGA TGACCCAGATGTCCAGATCAGCTGGTTTGTGA ACAACGTGGAAGTACACACAGCTCAGACACAA ACCCATAGAGAGGATTACAACAGTACTCTCCG GGTGGTCAGTGCCCTCCCCATCCAGCACCAGG ACTGGATGAGTGGCAAGGAGTTCAAATGCAAG GTCAACAACAAAGACCTCCCAGCGCCCATCGA GAGAACCATCTCAAAACCCAAAGGGTCAGTAA GAGCTCCACAGGTATATGTCTTGCCTCCACCAG AAGAAGAGATGACTAAGAAACAGGTCACTCTG ACCTGCATGGTCACAGACTTCATGCCTGAAGA CATTTACGTGGAGTGGACCAACAACGGGAAAA CAGAGCTAAACTACAAGAACACTGAACCAGTC CTGGACTCTGATGGTTCTTACTTCATGTACAGC AAGCTGAGAGTGGAAAAGAAGAACTGGGTGG AAAGAAATAGCTACTCCTGTTCAGTGGTCCAC GAGGGTCTGCACAATCACCACACGACTAAGAG CTTCTCCCGGACTCCGGGTAAATGA | |
| SM1B332 | pDR000029275 | ATGGCTTGGGTGTGGACCTTGCTATTCCTGATG GCAGCTGCCCAAAGTATACAGGCCCAGGTGCA GCTGAAAGAGTCCGGCCCTGGACTGGTGGCCC CCAGCCAGAGCCTGAGCATCACCTGTACCGTG TCCGGCCTGAGCCTGACCAGCTACGGCCTGTCT TGGGTCCGACAGCCCCCTGGCAAGGGCCTGGA ATGGCTGGGAGTGATCTGGGGCGACGGCAGCA CCAACTACCACAGCGCCCTGATCAGCAGACTG AGCATCAGCAAGGACAACAGCAAGAGCCAGG TGTTCCTGAAGCTGAACAGCCTGCAGAGCGAC GACACCGCCACCTACTACTGCGCCACCAGAGG CGACTACGGCAGCTACGCCATGGACTACTGGG GCCAGGGCACCAGCGTGACCGTGTCCTCTGCC AAAACAACAGCACCAAGTGTCTATCCACTGGC CCCTGTGTGTGGAGATACAACTGGCTCCTCGGT GACTCTAGGATGCCTGGTCAAGGGTTATTTCCC TGAGCCAGTGACCTTGACCTGGAACTCTGGAT CCCTGTCCAGTGGTGTGCACACCTTCCCAGCTG TCCTGCAGTCTGACCTCTACACCCTCAGCAGCT CAGTGACTGTAACCTCGAGCACCTGGCCCAGC CAGTCCATCACCTGCAATGTGGCCCACCCGGC AAGCAGCACCAAGGTGGACAAGAAAATTGAG CCCAGAGGGCCCACAATCAAGCCCTGTCCTCC ATGCAAATGCCCAGCACCTAACCTCTTGGGTG GACCATCCGTCTTCATCTTCCCTCCAAAGATCA AGGATGTACTCATGATCTCCCTGAGCCCCATA GTCACATGTGTGGTGGTGGATGTGAGCGAGGA TGACCCAGATGTCCAGATCAGCTGGTTTGTGA ACAACGTGGAAGTACACACAGCTCAGACACAA ACCCATAGAGAGGATTACAACAGTACTCTCCG GGTGGTCAGTGCCCTCCCCATCCAGCACCAGG ACTGGATGAGTGGCAAGGAGTTCAAATGCAAG GTCAACAACAAAGACCTCCCAGCGCCCATCGA GAGAACCATCTCAAAACCCAAAGGGTCAGTAA GAGCTCCACAGGTATATGTCTTGCCTCCACCAG AAGAAGAGATGACTAAGAAACAGGTCACTCTG ACCTGCATGGTCACAGACTTCATGCCTGAAGA CATTTACGTGGAGTGGACCAACAACGGGAAAA CAGAGCTAAACTACAAGAACACTGAACCAGTC CTGGACTCTGATGGTTCTTACTTCATGTACAGC AAGCTGAGAGTGGAAAAGAAGAACTGGGTGG | 1195 |

TABLE 47-continued

HlgA/LukE Antibody Heavy Chain Primary Transcripts

| mAB/Fab name | Construct ID | Heavy Chain Primary Transcript | SEQ ID NO: |
|---|---|---|---|
| | | AAAGAAATAGCTACTCCTGTTCAGTGGTCCAC GAGGGTCTGCACAATCACCACACGACTAAGAG CTTCTCCCGGACTCCGGGTAAATGA | |
| SM1B333 | pDR000029274 | ATGGCTTGGGTGTGGACCTTGCTATTCCTGATG GCAGCTGCCCAAAGTATACAGGCCGAGGTGCA GCTGCAGCAGTCTGGCGCTGAACTCGTGCGGC CTGGCGCCAGCGTGAAGCTGAGCTGTACCGCC AGCGGCTTCAACATCAAGGACAGCCTGATCCA CTGGGTCAAGCAGCGGCCCGAGCAGGGCCTGG AATGGATCGGCTGGATCGACCCCGAGGACGGC GAGACTAAGTACGCCCCCAAGTTCCAGGACAA GGCCGCCCTGACCACCGACACCAGCAGCAACA CCGCCTACCTGCACCTGAACAGCCTGACCAGC GAGGACACCGCCATCTACTACTGCGGCAGAGG CGGCCTGATCCTGGACTACTGGGGCCAGGGCA CCACCCTGACCGTGTCCTCTGCCAAAACAACA GCACCAAGTGTCTATCCACTGGCCCTGTGTGT GGAGATACAACTGGCTCCTCGGTGACTCTAGG ATGCCTGGTCAAGGGTTATTTCCCTGAGCCAGT GACCTTGACCTGGAACTCTGGATCCCTGTCCAG TGGTGTGCACACCTTCCCAGCTGTCCTGCAGTC TGACCTCTACACCCTCAGCAGCTCAGTGACTGT AACCTCGAGCACCTGGCCCAGCCAGTCCATCA CCTGCAATGTGGCCCACCCGGCAAGCAGCACC AAGGTGGACAAGAAAATTGAGCCCAGAGGGC CCACAATCAAGCCCTGTCCTCCATGCAAATGC CCAGCACCTAACCTCTTGGGTGGACCATCCGTC TTCATCTTCCCTCCAAAGATCAAGGATGTACTC ATGATCTCCCTGAGCCCCATAGTCACATGTGTG GTGGTGGATGTGAGCGAGGATGACCCAGATGT CCAGATCAGCTGGTTTGTGAACAACGTGGAAG TACACACAGCTCAGACACAAACCCATAGAGAG GATTACAACAGTACTCTCCGGGTGGTCAGTGC CCTCCCCATCCAGCACCAGGACTGGATGAGTG GCAAGGAGTTCAAATGCAAGGTCAACAACAAA GACCTCCCAGCGCCCATCGAGAGAACCATCTC AAAACCCAAAGGGTCAGTAAGAGCTCCACAGG TATATGTCTTGCCTCCACCAGAAGAAGAGATG ACTAAGAAACAGGTCACTCTGACCTGCATGGT CACAGACTTCATGCCTGAAGACATTTACGTGG AGTGGACCAACAACGGGAAAACAGAGCTAAA CTACAAGAACACTGAACCAGTCCTGGACTCTG ATGGTTCTTACTTCATGTACAGCAAGCTGAGA GTGGAAAAGAAGAACTGGGTGGAAAGAAATA GCTACTCCTGTTCAGTGGTCCACGAGGGTCTGC ACAATCACCACACGACTAAGAGCTTCTCCCGG ACTCCGGGTAAATGA | 1196 |
| SM1B334 | pDR000029273 | ATGGCTTGGGTGTGGACCTTGCTATTCCTGATG GCAGCTGCCCAAAGTATACAGGCCCAGATCCA GCTGGTGCAGAGCGGCCCTGAGCTGAAGAAAC CCGGCGAGACAGTGAAGATCAGCTGCAGAAGC AGCGGCTACACCTTCACCAACTACGGCCTGAA CTGGGTCAAGCAGGCCCCTGGCAAGGACCTGA AGTGGATGGGCTGGCTGAACACCTACACCGGC GAGCCCACCTACGCCGACACTTCAAGGGCAG ATTCGCCTTCAGCCTGGAAACCAGCGCCGGCA CCGCCTACCTGCAGATCAACAACCTGAAGAAC GAGGACACCGCCACCTACTTTTGCTCCCGGGA CTACCGCGAGGGCGACGCCATGGATTACTGGT CCAGGGCACCAGCGTGACCGTGTCCAGCGCC AAAACAACAGCACCAAGTGTCTATCCACTGGC CCTGTGTGTGGAGATACAACTGGCTCCTCGGT GACTCTAGGATGCCTGGTCAAGGGTTATTTCCC TGAGCCAGTGACCTTGACCTGGAACTCTGGAT CCCTGTCCAGTGGTGTGCACACCTTCCCAGCTG TCCTGCAGTCTGACCTCTACACCCTCAGCAGCT CAGTGACTGTAACCTCGAGCACCTGGCCCAGC CAGTCCATCACCTGCAATGTGGCCCACCCGGC AAGCAGCACCAAGGTGGACAAGAAAATTGAG CCCAGAGGGCCCACAATCAAGCCCTGTCCTCC ATGCAAATGCCCAGCACCTAACCTCTTGGGTG GACCATCCGTCTTCATCTTCCCTCCAAAGATCA AGGATGTACTCATGATCTCCCTGAGCCCCATA | 1197 |

TABLE 47-continued

HlgA/LukE Antibody Heavy Chain Primary Transcripts

| mAB/Fab name | Construct ID | Heavy Chain Primary Transcript | SEQ ID NO: |
|---|---|---|---|
| | | GTCACATGTGTGGTGGTGGATGTGAGCGAGGA<br>TGACCCAGATGTCCAGATCAGCTGGTTTGTGA<br>ACAACGTGGAAGTACACACAGCTCAGACACAA<br>ACCCATAGAGAGGATTACAACAGTACTCTCCG<br>GGTGGTCAGTGCCCTCCCCATCCAGCACCAGG<br>ACTGGATGAGTGGCAAGGAGTTCAAATGCAAG<br>GTCAACAACAAAGACCTCCCAGCGCCCATCGA<br>GAGAACCATCTCAAAACCCAAAGGGTCAGTAA<br>GAGCTCCACAGGTATATGTCTTGCCTCCACCAG<br>AAGAAGAGATGACTAAGAAACAGGTCACTCTG<br>ACCTGCATGGTCACAGACTTCATGCCTGAAGA<br>CATTTACGTGGAGTGGACCAACAACGGGAAAA<br>CAGAGCTAAACTACAAGAACACTGAACCAGTC<br>CTGGACTCTGATGGTTCTTACTTCATGTACAGC<br>AAGCTGAGAGTGGAAAAGAAGAACTGGGTGG<br>AAAGAAATAGCTACTCCTGTTCAGTGGTCCAC<br>GAGGGTCTGCACAATCACCACACGACTAAGAG<br>CTTCTCCCGGACTCCGGGTAAATGA | |
| SM1B335 | pDR000029272 | ATGGCTTGGGTGTGGACCTTGCTATTCCTGATG<br>GCAGCTGCCCAAAGTATACAGGCCGAGGTGCA<br>GCTGGTGGAAAGCGGCGGAGGACTGGTCAAGC<br>CTGGCGGCAGCCTGAAGCTGAGCTGCGCCGCC<br>AGCGGCTTCACCTTCAGCAGCTACGCCATGAG<br>CTGGGTCCGACAGACCCCCGAGAAGCGGCTGG<br>AATGGGTGGCCACCATCAGCACCAGCGGCAGC<br>TACACCTACTACCGGGACAGCGTGAAGGGCCG<br>GCTGACCATCAGCCGGGACAACGCCAAGAACA<br>CCCTGTACCTGCAGATGACCAGCCTGCGGAGC<br>GAGGACACCGCCATGTACTACTGCACCCGGCA<br>CGGCGACCACGACGGCTTCGATTACTGGGGCC<br>AGGGCACCACCCTGACCGTGTCCTCTGCCAAA<br>ACAACAGCACCAAGTGTCTATCCACTGGCCCC<br>TGTGTGTGGAGATACAACTGGCTCCTCGGTGA<br>CTCTAGGATGCCTGGTCAAGGGTTATTTCCCTG<br>AGCCAGTGACCTTGACCTGGAACTCTGGATCC<br>CTGTCCAGTGGTGTGCACACCTTCCCAGCTGTC<br>CTGCAGTCTGACCTCTACACCCTCAGCAGCTCA<br>GTGACTGTAACCTCGAGCACCTGGCCCAGCCA<br>GTCCATCACCTGCAATGTGGCCCACCCGGCAA<br>GCAGCACCAAGGTGGACAAGAAAATTGAGCCC<br>AGAGGGCCCACAATCAAGCCCTGTCCTCCATG<br>CAAATGCCCAGCACCTAACCTCTTGGGTGGAC<br>CATCCGTCTTCATCTTCCCTCCAAAGATCAAGG<br>ATGTACTCATGATCTCCCTGAGCCCCATAGTCA<br>CATGTGTGGTGGTGGATGTGAGCGAGGATGAC<br>CCAGATGTCCAGATCAGCTGGTTTGTGAACAA<br>CGTGGAAGTACACACAGCTCAGACACAAACCC<br>ATAGAGAGGATTACAACAGTACTCTCCGGGTG<br>GTCAGTGCCCTCCCCATCCAGCACCAGGACTG<br>GATGAGTGGCAAGGAGTTCAAATGCAAGGTCA<br>ACAACAAAGACCTCCCAGCGCCCATCGAGAGA<br>ACCATCTCAAAACCCAAAGGGTCAGTAAGAGC<br>TCCACAGGTATATGTCTTGCCTCCACCAGAAG<br>AAGAGATGACTAAGAAACAGGTCACTCTGACC<br>TGCATGGTCACAGACTTCATGCCTGAAGACAT<br>TTACGTGGAGTGGACCAACAACGGGAAAACAG<br>AGCTAAACTACAAGAACACTGAACCAGTCCTG<br>GACTCTGATGGTTCTTACTTCATGTACAGCAAG<br>CTGAGAGTGGAAAAGAAGAACTGGGTGGAAA<br>GAAATAGCTACTCCTGTTCAGTGGTCCACGAG<br>GGTCTGCACAATCACCACACGACTAAGAGCTT<br>CTCCCGGACTCCGGGTAAATGA | 1198 |
| SM1B336 | pDR000029271 | ATGGCTTGGGTGTGGACCTTGCTATTCCTGATG<br>GCAGCTGCCCAAAGTATACAGGCCGAGGTGCA<br>GCTGGTGGAAAGCGGCGGAGGACTGGTCAAGC<br>CTGGCGGCAGCCTGAAGCTGAGCTGCGTGGCC<br>TCCGGCTTCAGCTTCAGCAACTACGCCATGAG<br>CTGGGTCCGACAGACCCCCGAGCGGAGACTGG<br>AATGGGTGGCCACCATCAACAGCGGCGGCAGC<br>TTCAGCTTTTTCCCAGACTCCGTGAAGGGCCGG<br>TTCACCATCAGCCGGGACAGCGCCAAGAACAC<br>CCTGTACCTGCAGATGAGCAGCCTGCGGAGCG<br>ACGACACCGCCATGTACTACTGCACCCGGCAC | 1199 |

TABLE 47-continued

HlgA/LukE Antibody Heavy Chain Primary Transcripts

| mAB/Fab name | Construct ID | Heavy Chain Primary Transcript | SEQ ID NO: |
|---|---|---|---|
| | | TGGGACCACCCTTGGTTTGCCTACTGGGGCCA<br>GGGCACCCTGGTCACCGTGTCTGCTGCCAAAA<br>CAACAGCACCAAGTGTCTATCCACTGGCCCCT<br>GTGTGTGGAGATACAACTGGCTCCTCGGTGAC<br>TCTAGGATGCCTGGTCAAGGGTTATTTCCCTGA<br>GCCAGTGACCTTGACCTGGAACTCTGGATCCCT<br>GTCCAGTGGTGTGCACACCTTCCCAGCTGTCCT<br>GCAGTCTGACCTCTACACCCTCAGCAGCTCAGT<br>GACTGTAACCTCGAGCACCTGGCCCAGCCAGT<br>CCATCACCTGCAATGTGGCCCACCCGGCAAGC<br>AGCACCAAGGTGGACAAGAAAATTGAGCCCA<br>GAGGGCCCACAATCAAGCCCTGTCCTCCATGC<br>AAATGCCCAGCACCTAACCTCTTGGGTGGACC<br>ATCCGTCTTCATCTTCCCTCCAAAGATCAAGGA<br>TGTACTCATGATCTCCCTGAGCCCCATAGTCAC<br>ATGTGTGGTGGTGGATGTGAGCGAGGATGACC<br>CAGATGTCCAGATCAGCTGGTTTGTGAACAAC<br>GTGGAAGTACACACAGCTCAGACACAAACCCA<br>TAGAGAGGATTACAACAGTACTCTCCGGGTGG<br>TCAGTGCCCTCCCCATCCAGCACCAGGACTGG<br>ATGAGTGGCAAGGAGTTCAAATGCAAGGTCAA<br>CAACAAAGACCTCCCAGCGCCCATCGAGAGAA<br>CCATCTCAAAACCCAAAGGGTCAGTAAGAGCT<br>CCACAGGTATATGTCTTGCCTCCACCAGAAGA<br>AGAGATGACTAAGAAACAGGTCACTCTGACCT<br>GCATGGTCACAGACTTCATGCCTGAAGACATT<br>TACGTGGAGTGGACCAACAACGGGAAAACAG<br>AGCTAAACTACAAGAACACTGAACCAGTCCTG<br>GACTCTGATGGTTCTTACTTCATGTACAGCAAG<br>CTGAGAGTGGAAAAGAAGAACTGGGTGGAAA<br>GAAATAGCTACTCCTGTTCAGTGGTCCACGAG<br>GGTCTGCACAATCACCACACGACTAAGAGCTT<br>CTCCCCGGACTCCGGGTAAATGA | |
| SM1B337 | pDR000029271 | ATGGCTTGGGTGTGGACCTTGCTATTCCTGATG<br>GCAGCTGCCCAAAGTATACAGGCCGAGGTGCA<br>GCTGGTGGAAAGCGGCGGAGGACTGGTCAAGC<br>CTGGCGGCAGCCTGAAGCTGAGCTGCGTGGCC<br>TCCGGCTTCAGCTTCAGCAACTACGCCATGAG<br>CTGGGTCCGACAGACCCCCGAGCGGAGACTGG<br>AATGGGTGGCCACCATCAACAGCGGCGGCAGC<br>TTCAGCTTTTTTCCCAGACTCCGTGAAGGGCCGG<br>TTCACCATCAGCCGGGACAGCGCCAAGAACAC<br>CCTGTACCTGCAGATGAGCAGCCTGCGGAGCG<br>ACGACACCGCCATGTACTACTGCACCCGGCAC<br>TGGGACCACCCTTGGTTTGCCTACTGGGGCCA<br>GGGCACCCTGGTCACCGTGTCTGCTGCCAAAA<br>CAACAGCACCAAGTGTCTATCCACTGGCCCCT<br>GTGTGTGGAGATACAACTGGCTCCTCGGTGAC<br>TCTAGGATGCCTGGTCAAGGGTTATTTCCCTGA<br>GCCAGTGACCTTGACCTGGAACTCTGGATCCCT<br>GTCCAGTGGTGTGCACACCTTCCCAGCTGTCCT<br>GCAGTCTGACCTCTACACCCTCAGCAGCTCAGT<br>GACTGTAACCTCGAGCACCTGGCCCAGCCAGT<br>CCATCACCTGCAATGTGGCCCACCCGGCAAGC<br>AGCACCAAGGTGGACAAGAAAATTGAGCCCA<br>GAGGGCCCACAATCAAGCCCTGTCCTCCATGC<br>AAATGCCCAGCACCTAACCTCTTGGGTGGACC<br>ATCCGTCTTCATCTTCCCTCCAAAGATCAAGGA<br>TGTACTCATGATCTCCCTGAGCCCCATAGTCAC<br>ATGTGTGGTGGTGGATGTGAGCGAGGATGACC<br>CAGATGTCCAGATCAGCTGGTTTGTGAACAAC<br>GTGGAAGTACACACAGCTCAGACACAAACCCA<br>TAGAGAGGATTACAACAGTACTCTCCGGGTGG<br>TCAGTGCCCTCCCCATCCAGCACCAGGACTGG<br>ATGAGTGGCAAGGAGTTCAAATGCAAGGTCAA<br>CAACAAAGACCTCCCAGCGCCCATCGAGAGAA<br>CCATCTCAAAACCCAAAGGGTCAGTAAGAGCT<br>CCACAGGTATATGTCTTGCCTCCACCAGAAGA<br>AGAGATGACTAAGAAACAGGTCACTCTGACCT<br>GCATGGTCACAGACTTCATGCCTGAAGACATT<br>TACGTGGAGTGGACCAACAACGGGAAAACAG<br>AGCTAAACTACAAGAACACTGAACCAGTCCTG<br>GACTCTGATGGTTCTTACTTCATGTACAGCAAG<br>CTGAGAGTGGAAAAGAAGAACTGGGTGGAAA | 1200 |

TABLE 47-continued

HlgA/LukE Antibody Heavy Chain Primary Transcripts

| mAB/Fab name | Construct ID | Heavy Chain Primary Transcript | SEQ ID NO: |
|---|---|---|---|
| | | GAAATAGCTACTCCTGTTCAGTGGTCCACGAG<br>GGTCTGCACAATCACCACACGACTAAGAGCTT<br>CTCCCGGACTCCGGGTAAATGA | |
| SM1B338 | pDR000029271 | ATGGCTTGGGTGTGGACCTTGCTATTCCTGATG<br>GCAGCTGCCCAAAGTATACAGGCCGAGGTGCA<br>GCTGGTGGAAAGCGGCGGAGGACTGGTCAAGC<br>CTGGCGGCAGCCTGAAGCTGAGCTGCGTGGCC<br>TCCGGCTTCAGCTTCAGCAACTACGCCATGAG<br>CTGGGTCCGACAGACCCCCGAGCGGAGACTGG<br>AATGGGTGGCCACCATCAACAGCGGCGGCAGC<br>TTCAGCTTTTTCCCAGACTCCGTGAAGGGCCGG<br>TTCACCATCAGCCGGGACAGCGCCAAGAACAC<br>CCTGTACCTGCAGATGAGCAGCCTGCGGAGCG<br>ACGACACCGCCATGTACTACTGCACCCGGCAC<br>TGGGACCACCCTTGGTTTGCCTACTGGGGCCA<br>GGGCACCCTGGTCACCGTGTCTGCTGCCAAAA<br>CAACAGCACCAAGTGTCTATCCACTGGCCCCT<br>GTGTGTGGAGATACAACTGGCTCCTCGGTGAC<br>TCTAGGATGCCTGGTCAAGGGTTATTTCCCTGA<br>GCCAGTGACCTTGACCTGGAACTCTGGATCCCT<br>GTCCAGTGGTGTGCACACCTTCCCAGCTGTCCT<br>GCAGTCTGACCTCTACACCCTCAGCAGCTCAGT<br>GACTGTAACCTCGAGCACCTGGCCCAGCCAGT<br>CCATCACCTGCAATGTGGCCCACCCGGCAAGC<br>AGCACCAAGGTGGACAAGAAAATTGAGCCCA<br>GAGGGCCCACAATCAAGCCCTGTCCTCCATGC<br>AAATGCCCAGCACCTAACCTCTTGGGTGGACC<br>ATCCGTCTTCATCTTCCCTCCAAAGATCAAGGA<br>TGTACTCATGATCTCCCTGAGCCCCATAGTCAC<br>ATGTGTGGTGGTGGATGTGAGCGAGGATGACC<br>CAGATGTCCAGATCAGCTGGTTTGTGAACAAC<br>GTGGAAGTACACACAGCTCAGACACAAACCCA<br>TAGAGAGGATTACAACAGTACTCTCCGGGTGG<br>TCAGTGCCCTCCCCATCCAGCACCAGGACTGG<br>ATGAGTGGCAAGGAGTTCAAATGCAAGGTCAA<br>CAACAAAGACCTCCCAGCGCCCATCGAGAGAA<br>CCATCTCAAAACCCAAAGGGTCAGTAAGAGCT<br>CCACAGGTATATGTCTTGCCTCCACCAGAAGA<br>AGAGATGACTAAGAAACAGGTCACTCTGACCT<br>GCATGGTCACAGACTTCATGCCTGAAGACATT<br>TACGTGGAGTGGACCAACAACGGGAAAACAG<br>AGCTAAACTACAAGAACACTGAACCAGTCCTG<br>GACTCTGATGGTTCTTACTTCATGTACAGCAAG<br>CTGAGAGTGGAAAAGAAGAACTGGGTGGAAA<br>GAAATAGCTACTCCTGTTCAGTGGTCCACGAG<br>GGTCTGCACAATCACCACACGACTAAGAGCTT<br>CTCCCGGACTCCGGGTAAATGA | 1201 |
| SM1B339 | pDR000029270 | ATGGCTTGGGTGTGGACCTTGCTATTCCTGATG<br>GCAGCTGCCCAAAGTATACAGGCCGAGGTGCA<br>GCTGCAGCAGTCTGGCGCTGAACTCGTGCGGC<br>CTGGCGCCAGCGTGAAGCTGAGCTGCACCACC<br>AGCGGCTTCAACATCAAGGACAGCCTGATCTA<br>CTGGGTCAAGCAGCGGCCCGAGCAGGGCCTGG<br>AATGGATCGGCTGGATCGACCCCGAGGACGGC<br>GAGACAAAGTTCGCCCCCAGATTCCAGGACAA<br>GGCCACCATCACCAGCGACACCAGCAGCAACA<br>CCGCCTACCTGCAGCTGAGCAGCCTGACCAGC<br>AAGGACACCGCCATCTACTACTGCACCCGGTC<br>CTTCGGCGTGTGCTGGGGCCAGGGCACCCTGG<br>TCACAGTGTCTGCCGCCAAAACAACAGCACCA<br>AGTGTCTATCCACTGGCCCCTGTGTGTGGAGAT<br>ACAACTGGCTCCTCGGTGACTCTAGGATGCCT<br>GGTCAAGGGTTATTTCCCTGAGCCAGTGACCTT<br>GACCTGGAACTCTGGATCCCTGTCCAGTGGTGT<br>GCACACCTTCCCAGCTGTCCTGCAGTCTGACCT<br>CTACACCCTCAGCAGCTCAGTGACTGTAACCTC<br>GAGCACCTGGCCCAGCCAGTCCATCACCTGCA<br>ATGTGGCCCACCCGGCAAGCAGCACCAAGGTG<br>GACAAGAAAATTGAGCCCAGAGGGCCCACAAT<br>CAAGCCCTGTCCTCCATGCAAATGCCCAGCAC<br>CTAACCTCTTGGGTGGACCATCCGTCTTCATCT<br>TCCCTCCAAAGATCAAGGATGTACTCATGATCT<br>CCCTGAGCCCCATAGTCACATGTGTGGTGGTG | 1202 |

TABLE 47-continued

HlgA/LukE Antibody Heavy Chain Primary Transcripts

| mAB/Fab name | Construct ID | Heavy Chain Primary Transcript | SEQ ID NO: |
|---|---|---|---|
| | | GATGTGAGCGAGGATGACCCAGATGTCCAGAT CAGCTGGTTTGTGAACAACGTGGAAGTACACA CAGCTCAGACACAAACCCATAGAGAGGATTAC AACAGTACTCTCCGGGTGGTCAGTGCCCTCCCC ATCCAGCACCAGGACTGGATGAGTGGCAAGGA GTTCAAATGCAAGGTCAACAACAAAGACCTCC CAGCGCCCATCGAGAGAACCATCTCAAAACCC AAAGGGTCAGTAAGAGCTCCACAGGTATATGT CTTGCCTCCACCAGAAGAAGAGATGACTAAGA AACAGGTCACTCTGACCTGCATGGTCACAGAC TTCATGCCTGAAGACATTTACGTGGAGTGGAC CAACAACGGGAAAACAGAGCTAAACTACAAG AACACTGAACCAGTCCTGGACTCTGATGGTTCT TACTTCATGTACAGCAAGCTGAGAGTGGAAAA GAAGAACTGGGTGGAAAGAAATAGCTACTCCT GTTCAGTGGTCCACGAGGGTCTGCACAATCAC CACACGACTAAGAGCTTCTCCCGGACTCCGGG TAAATGA | |
| SM1B340 | pDR000029269 | ATGGCTTGGGTGTGGACCTTGCTATTCCTGATG GCAGCTGCCCAAAGTATACAGGCCGAGGTGCA GCTGCAGCAGTCTGGCGCTGAACTCGTGCGGC CTGGCGCCAGCGTGAAGCTGAGCTGCACCACC AGCGGCTTCAACATCAAGGACAGCCTGATCTA CTGGGTCAAGCAGCGGCCCGAGCAGGGCCTGG AATGGATCGGCTGGATCGACCCCGAGGACGGC GAGACAAAGTTCGCCCCCAGATTCCAGGACAA GGCCACCATCACCAGCGACACCAGCAGCAACA CCGCCTACCTGCGGCTGAGCAGCCTGACCAGC GAGGACACCGCCATCTACTACTGCACCCGGTC CTTCGGCGTGTGCTGGGGCCAGGGCACCCTGG TCACAGTGTCTGCCGCCAAAACAACAGCACCA AGTGTCTATCCACTGGCCCCTGTGTGTGGAGAT ACAACTGGCTCCTCGGTGACTCTAGGATGCCT GGTCAAGGGTTATTTCCCTGAGCCAGTGACCTT GACCTGGAACTCTGGATCCCTGTCCAGTGGTGT GCACACCTTCCCAGCTGTCCTGCAGTCTGACCT CTACACCCTCAGCAGCTCAGTGACTGTAACCTC GAGCACCTGGCCCAGCCAGTCCATCACCTGCA ATGTGGCCCACCCGGCAAGCAGCACCAAGGTG GACAAGAAAATTGAGCCCAGAGGGCCCACAAT CAAGCCCTGTCCTCCATGCAAATGCCCAGCAC CTAACCTCTTGGGTGGACCATCCGTCTTCATCT TCCCTCCAAAGATCAAGGATGTACTCATGATCT CCCTGAGCCCCATAGTCACATGTGTGGTGGTG GATGTGAGCGAGGATGACCCAGATGTCCAGAT CAGCTGGTTTGTGAACAACGTGGAAGTACACA CAGCTCAGACACAAACCCATAGAGAGGATTAC AACAGTACTCTCCGGGTGGTCAGTGCCCTCCCC ATCCAGCACCAGGACTGGATGAGTGGCAAGGA GTTCAAATGCAAGGTCAACAACAAAGACCTCC CAGCGCCCATCGAGAGAACCATCTCAAAACCC AAAGGGTCAGTAAGAGCTCCACAGGTATATGT CTTGCCTCCACCAGAAGAAGAGATGACTAAGA AACAGGTCACTCTGACCTGCATGGTCACAGAC TTCATGCCTGAAGACATTTACGTGGAGTGGAC CAACAACGGGAAAACAGAGCTAAACTACAAG AACACTGAACCAGTCCTGGACTCTGATGGTTCT TACTTCATGTACAGCAAGCTGAGAGTGGAAAA GAAGAACTGGGTGGAAAGAAATAGCTACTCCT GTTCAGTGGTCCACGAGGGTCTGCACAATCAC CACACGACTAAGAGCTTCTCCCGGACTCCGGG TAAATGA | 1203 |

TABLE 48

HlgA/LukE Antibody Light Chain CDSs

| mAB/Fab name | Construct ID | Light Chain CDS | SEQ ID NO: |
|---|---|---|---|
| SM1B302 | pDR000027850 | GACATCCAGATGACCCAGAGCCCTAGCAGCCT GAGCGCCTCTCTGGGCGAGAGAGTGTCCCTGA CCTGCAGAGCCAGCCAGGACATCGGCAGCTCC CTGAACTGGCTGCAGCAGGAACCCGACGGCAC CATCAAGCGGCTGATCTACGCCACCAGCAGCC TGGATAGCGGCGTGCCCAAGAGATTCAGCGGC AGCAGAAGCGGCAGCGACTACAGCCTGACCAT CTCCAGCCTGGAATCCGAGGACTTCGTGGACT ACTACTGCCTGCAGTACGCCAGCAGCCCCTGG ACCTTTGGCGGAGGCACCAAGCTGGAAATCAA GCGGGCTGATGCTGCACCGACTGTGTCCATCTT CCCACCATCCAGTGAGCAGTTAACATCTGGAG GTGCCTCAGTCGTGTGCTTCTTGAACAACTTCT ACCCCAAAGACATCAATGTCAAGTGGAAGATT GATGGCAGTGAACGACAAAATGGCGTCCTGAA CAGTTGGACTGATCAGGACAGCAAAGACAGCA CCTACAGCATGAGCAGCACCCTCACGTTGACC AAGGACGAGTATGAACGACATAACAGCTATAC CTGTGAGGCCACTCACAAGACATCAACTTCAC CCATTGTCAAGAGCTTCAACAGGAATGAGTGT | 1204 |
| SM1B303 | pDR000029323 | GACATCCAGATGACCCAGACCACCAGCAGCCT GAGCGCCAGCCTGGGCGACAGAGTGACCATCA GCTGCTGGGCCAGCCAGGACATCAGAAGCTAC CTGAACTGGTATCAGCAGAAACCCGACGGCAC CGTGAAGCTGCTGATCTACTACACCAGCCGGC TGCACAGCGGCGTGCCCAGCAGATTTTCTGGC AGCGGCAGCGGCACCGACTTCAGCCTGACCAT CTCCAACCTGGAACAGGAAGATATCGCTACCT ACTTCTGTCAGCAGGGCAACACCCTGCCCTAC ACCTTCGGCGGAGGCACCAAGCTGGAAATCAA GCGGGCTGATGCTGCACCGACTGTGTCCATCTT CCCACCATCCAGTGAGCAGTTAACATCTGGAG GTGCCTCAGTCGTGTGCTTCTTGAACAACTTCT ACCCCAAAGACATCAATGTCAAGTGGAAGATT GATGGCAGTGAACGACAAAATGGCGTCCTGAA CAGTTGGACTGATCAGGACAGCAAAGACAGCA CCTACAGCATGAGCAGCACCCTCACGTTGACC AAGGACGAGTATGAACGACATAACAGCTATAC CTGTGAGGCCACTCACAAGACATCAACTTCAC CCATTGTCAAGAGCTTCAACAGGAATGAGTGT | 1205 |
| SM1B304 | pDR000029322 | GACATCCAGATGACCCAGAGCCCCAGCAGCCT GAGCGCCAGCCTGGGCGAGAGAGTGTCCCTGA CCTGCCGGGCCAGCCAGGAAATCAGCGGCTAC CTGAGCTGGCTGCAGCAGAAGCCCGACGGCAC CATCAAGCGGCTGATCTACGCCGCCAGCACCC TGGACAGCGGCGTGCCCAAGAGATTCAGCGGC AGCCGCAGCGGCAGCGACTACAGCCTGACCAT CAGCAGCCTGGAAAGCGAGGACTTCGCCGACT ACTACTGCCTGCAGTACGCCAGCTACCCCCGG ACCTTCGGCGGAGGCACCAAGCTGGAAATCAA GCGGGCTGATGCTGCACCGACTGTGTCCATCTT CCCACCATCCAGTGAGCAGTTAACATCTGGAG GTGCCTCAGTCGTGTGCTTCTTGAACAACTTCT ACCCCAAAGACATCAATGTCAAGTGGAAGATT GATGGCAGTGAACGACAAAATGGCGTCCTGAA CAGTTGGACTGATCAGGACAGCAAAGACAGCA CCTACAGCATGAGCAGCACCCTCACGTTGACC AAGGACGAGTATGAACGACATAACAGCTATAC CTGTGAGGCCACTCACAAGACATCAACTTCAC CCATTGTCAAGAGCTTCAACAGGAATGAGTGT | 1206 |
| SM1B305 | pDR000029321 | GACGTGCTGATGACCCAGACCCCCCTGAGCCT GCCCGTGTCTCTGGGCGATCAGGCCAGCATCA GCTGCCGGTCCAGCCAGATCATCGTGCACAGC AACGGCAACACCTACCTGGACTGGTATCTGCA GAAGCCCGGCCAGAGCCCCAAGCTGCTGATCT ACAAGATCAGCAACCGGTTCAGCGGCGTGCCC GACAGATTCAGCGGCAGCGGCTCCGGCACCGA CTTCACCCTGAAGATCAGCCGGGTGGAAGCCG AGGACCTGGGCGTGTACTACTGTTTTCAGGGC AGCCACGTGCCCTGGACCTTCGGCGGAGGCAC CAAGCTGGAAATCAAGCGGGCTGATGCTGCAC | 1207 |

TABLE 48-continued

HlgA/LukE Antibody Light Chain CDSs

| mAB/Fab name | Construct ID | Light Chain CDS | SEQ ID NO: |
|---|---|---|---|
| | | CGACTGTGTCCATCTTCCCACCATCCAGTGAGC AGTTAACATCTGGAGGTGCCTCAGTCGTGTGCT TCTTGAACAACTTCTACCCCAAAGACATCAAT GTCAAGTGGAAGATTGATGGCAGTGAACGACA AAATGGCGTCCTGAACAGTTGGACTGATCAGG ACAGCAAAGACAGCACCTACAGCATGAGCAGC ACCCTCACGTTGACCAAGGACGAGTATGAACG ACATAACAGCTATACCTGTGAGGCCACTCACA AGACATCAACTTCACCCATTGTCAAGAGCTTC AACAGGAATGAGTGT | |
| SM1B306 | pDR000029320 | GACGTGGTGGTCACCCAGACCCCCCTGAGCCT GCCCGTGTCCTTCGGCGACCAGGTGTCCATCA GCTGCAGAAGCAGCCAGAGCCTGGCCAACAGC TACGGCAACACCTACCTGAGCTGGTATCTGCA CAAGCCCGGCCAGAGCCCCCAGCTGCTGATCT ACGGCATCAGCAACCGGTTCAGCGGCGTGCCC GACAGATTCAGCGGCAGCGGCTCCGGCACCGA CTTCACCCTGAAGATCAGCACCATCAAGCCCG AGGGCCTGGGCATGTACTACTGTCTGCAGGGC ACCCACCAGCCCCCCACCTTTGGCGCTGGCAC CAAGCTGGAACTGAAGCGGGCTGATGCTGCAC CGACTGTGTCCATCTTCCCACCATCCAGTGAGC AGTTAACATCTGGAGGTGCCTCAGTCGTGTGCT TCTTGAACAACTTCTACCCCAAAGACATCAAT GTCAAGTGGAAGATTGATGGCAGTGAACGACA AAATGGCGTCCTGAACAGTTGGACTGATCAGG ACAGCAAAGACAGCACCTACAGCATGAGCAGC ACCCTCACGTTGACCAAGGACGAGTATGAACG ACATAACAGCTATACCTGTGAGGCCACTCACA AGACATCAACTTCACCCATTGTCAAGAGCTTC AACAGGAATGAGTGT | 1208 |
| SM1B307 | pDR000029319 | GACATCGTGCTGACCCAGAGCCCTGCCAGCCT GGCCGTGTCTCTGGGCCAGAGAGCCACCATCA GCTGCCGGGCCAGCGAGAGCGTGGACAGCTAC GGCAACAGCTTCATGCACTGGTATCAGCAGAA GCCCGGCCAGCCCCCCAAGCTGCTGATCTACC GGGCCAGCAACCTGGAAAGCGGCATCCCCGCC AGATTCAGCGGCAGCGGCAGCCGGACCGACTT CACCCTGACCATCAACCCCGTGGAAGCCGACG ACGTGGCCACCTACTACTGCCAGCAGAGCAAC GAGGACCCCCCCTGGACCTTCGGCGGAGGCAC CAAGCTGGAAATCAAGCGGGCTGATGCTGCAC CGACTGTGTCCATCTTCCCACCATCCAGTGAGC AGTTAACATCTGGAGGTGCCTCAGTCGTGTGCT TCTTGAACAACTTCTACCCCAAAGACATCAAT GTCAAGTGGAAGATTGATGGCAGTGAACGACA AAATGGCGTCCTGAACAGTTGGACTGATCAGG ACAGCAAAGACAGCACCTACAGCATGAGCAGC ACCCTCACGTTGACCAAGGACGAGTATGAACG ACATAACAGCTATACCTGTGAGGCCACTCACA AGACATCAACTTCACCCATTGTCAAGAGCTTC AACAGGAATGAGTGT | 1209 |
| SM1B308 | pDR000029318 | GACATCGTGATGAGCCAGAGCCCCAGCAGCCT GGCCGTGTCTGCCGGCGAGAAAGTGACCATGA GCTGCAAGAGCAGCCAGAGCCTGCTGAACAGC CGGACCCGGAAGAACTACCTGGCCTGGTATCA GCAGAAGCCCGGCCAGTCCCCCAAGCTGCTGA TCTACTGGGCCAGCACCCGCGAGAGCGGCGTG CCCGATAGATTCACAGGCAGCGGCAGCGGCAC CGACTTCACCCTGACCATCAGCAGCGTGCAGG CCGAGGATCTGGCCGTGTACTACTGCAAGCAG AGCTACAACCTGTGGACCTTCGGCGGAGGCAC CAAGCTGGAAATCAAGCGGGCTGATGCTGCAC CGACTGTGTCCATCTTCCCACCATCCAGTGAGC AGTTAACATCTGGAGGTGCCTCAGTCGTGTGCT TCTTGAACAACTTCTACCCCAAAGACATCAAT GTCAAGTGGAAGATTGATGGCAGTGAACGACA AAATGGCGTCCTGAACAGTTGGACTGATCAGG ACAGCAAAGACAGCACCTACAGCATGAGCAGC ACCCTCACGTTGACCAAGGACGAGTATGAACG ACATAACAGCTATACCTGTGAGGCCACTCACA | 1210 |

TABLE 48-continued

HlgA/LukE Antibody Light Chain CDSs

| mAB/Fab name | Construct ID | Light Chain CDS | SEQ ID NO: |
|---|---|---|---|
| | | AGACATCAACTTCACCCATTGTCAAGAGCTTC AACAGGAATGAGTGT | |
| SM1B309 | pDR000029317 | GACGTGGTCATGACCCAGACCCCCCTGAGCCT GCCCGTGTCTCTGGGCGATCAGGCCAGCATCA GCTGCAGAAGCAGCCAGAGCCTGCTGCACAGC AACGGCAAGACCTACCTGCACTGGTATCTGCA GAAGCCCGGCCAGAGCCCCAAGCTGCTGATCT ACAAGGTGTCCAACCGGTTCAGCGGCGTGCCC GACAGATTCAGCGGCAGCGGCTCCGGCACCGA CTTCACCCTGAAGATCAGCCGGGTGGAAGCCG AGGACCTGGGCGTGTACTTCTGCAGCCAGTCC ACCCACGTGCCCCTGACCTTCGGAGCCGGCAC CAAGCTGGAACTGAAGCGGGCTGATGCTGCAC CGACTGTGTCCATCTTCCCACCATCCAGTGAGC AGTTAACATCTGGAGGTGCCTCAGTCGTGTGCT TCTTGAACAACTTCTACCCCAAAGACATCAAT GTCAAGTGGAAGATTGATGGCAGTGAACGACA AAATGGCGTCCTGAACAGTTGGACTGATCAGG ACAGCAAAGACAGCACCTACAGCATGAGCAGC ACCCTCACGTTGACCAAGGACGAGTATGAACG ACATAACAGCTATACCTGTGAGGCCACTCACA AGACATCAACTTCACCCATTGTCAAGAGCTTC AACAGGAATGAGTGT | 1211 |
| SM1B310 | pDR000029316 | GACATCGTGATGACCCAGAGCCACAAGTTCAT GAGCACCAGCGTGGGCGACCGGGTGTCCATCA CATGCAAGGCCAGCCAGGATGTGTCTGCCGCC GTGGCCTGGTATCAGCAGAAGCCCGGCCAGAG CCCCAAGCTGCTGATCTACTGGGCCAGCACCA GACACACCGGCGTGCCCGACAGATTCACAGGC AGCGGCAGCGGCACCGACTACACCCTGACCAT CAGCAGCGTGCAGGCCGAGGACCTGGCCCTGT ACTACTGCCAGCAGCACTACAGCACCCCCGGC ACCTTCGGCGGAGGCACCAAGCTGGAAATCAA GCGGGCTGATGCTGCACCGACTGTGTCCATCTT CCCACCATCCAGTGAGCAGTTAACATCTGGAG GTGCCTCAGTCGTGTGCTTCTTGAACAACTTCT ACCCCAAAGACATCAATGTCAAGTGGAAGATT GATGGCAGTGAACGACAAAATGGCGTCCTGAA CAGTTGGACTGATCAGGACAGCAAAGACAGCA CCTACAGCATGAGCAGCACCCTCACGTTGACC AAGGACGAGTATGAACGACATAACAGCTATAC CTGTGAGGCCACTCACAAGACATCAACTTCAC CCATTGTCAAGAGCTTCAACAGGAATGAGTGT | 1212 |
| SM1B311 | pDR000029315 | GACGTGCTGATGACCCAGACCCCCCTGAGCCT GCCCGTGTCTCTGGGCGATCAGGCCAGCATCA GCTGCCGGTCCAGCCAGACCATCGTGCACAGC AGCGGCAACACCTACCTGGAATGGTATCTGCA GCGGCCTGGCCAGAGCCCCAAGCTGCTGATCT ACAAGGTGTCCAACCGGTTCAGCGGCGTGCCC GACAGATTCAGCGGCAGCGGCTCCGGCACCGA CTTCACCCTGAAGATCAGCCGGGTGGAAGCCG AGGACCTGGGCGTGTACTACTGTTTTCAGGGC AGCCACGTGCCCACACTTCGGCGGAGGCAC CAAGCTGGAAATCAAGCGGGCTGATGCTGCAC CGACTGTGTCCATCTTCCCACCATCCAGTGAGC AGTTAACATCTGGAGGTGCCTCAGTCGTGTGCT TCTTGAACAACTTCTACCCCAAAGACATCAAT GTCAAGTGGAAGATTGATGGCAGTGAACGACA AAATGGCGTCCTGAACAGTTGGACTGATCAGG ACAGCAAAGACAGCACCTACAGCATGAGCAGC ACCCTCACGTTGACCAAGGACGAGTATGAACG ACATAACAGCTATACCTGTGAGGCCACTCACA AGACATCAACTTCACCCATTGTCAAGAGCTTC AACAGGAATGAGTGT | 1213 |
| SM1B312 | pDR000029297 | GACATCCAGATGACCCAGACCACCAGCAGCCT GAGCGCCAGCCTGGGCGACAGAGTGACCATCA GCTGTAGCGCCTCCCAGGGCATCAGCAACTAC CTGAACTGGTATCAGCAGAAACCCGACGGCAC CGTGAAGCTGCTGATCTACTACACCAGCTCCCT GCACAGCGGCGTGCCCAGCAGATTTTCTGGCA | 1214 |

TABLE 48-continued

HlgA/LukE Antibody Light Chain CDSs

| mAB/Fab name | Construct ID | Light Chain CDS | SEQ ID NO: |
|---|---|---|---|
| | | GCGGCAGCGGCACCGACTACAGCCTGACCATC TCCAACCTGGAACCCGAGGATATCGCCACCTA CTACTGCCAGCAGTACAGCAAGCTGCCCTTCA CCTTCGGCTCCGGCACCAAGCTGGAAATCAAG CGGGCTGATGCTGCACCGACTGTGTCCATCTTC CCACCATCCAGTGAGCAGTTAACATCTGGAGG TGCCTCAGTCGTGTGCTTCTTGAACAACTTCTA CCCCAAAGACATCAATGTCAAGTGGAAGATTG ATGGCAGTGAACGACAAAATGGCGTCCTGAAC AGTTGGACTGATCAGGACAGCAAAGACAGCAC CTACAGCATGAGCAGCACCCTCACGTTGACCA AGGACGAGTATGAACGACATAACAGCTATACC TGTGAGGCCACTCACAAGACATCAACTTCACC CATTGTCAAGAGCTTCAACAGGAATGAGTGT | |
| SM1B313 | pDR000029314 | GACATCGTGATGAGCCAGAGCCCCAGCAGCCT GGCCGTGTCCGTGGGCGAGAAAGTGACCATGA GCTGCAAGAGCAGCCAGAGCCTGCTGTACAGC TCCAACCAGAAGAACTACCTGGCCTGGTATCA GCAGAAGCCCGGCCAGTCCCCCAAGCTGCTGA TCTACTGGGCCAGCACCCGCGAGAGCGGCGTG CCAGATAGACTGACAGGCAGCGGCAGCGGCAC CGACTTCACCCTGACCATCAGCAGCGTGAAGG CCGAGGATCTGGCCGTGTACTACTGCCAGCAG TACTACAGCTACCCCTACACCTTCGGCGGAGG CACCAAGCTGGAAATCAAGCGGGCTGATGCTG CACCGACTGTGTCCATCTTCCCACCATCCAGTG AGCAGTTAACATCTGGAGGTGCCTCAGTCGTG TGCTTCTTGAACAACTTCTACCCCAAAGACATC AATGTCAAGTGGAAGATTGATGGCAGTGAACG ACAAAATGGCGTCCTGAACAGTTGGACTGATC AGGACAGCAAAGACAGCACCTACAGCATGAG CAGCACCCTCACGTTGACCAAGGACGAGTATG AACGACATAACAGCTATACCTGTGAGGCCACT CACAAGACATCAACTTCACCCATTGTCAAGAG CTTCAACAGGAATGAGTGT | 1215 |
| SM1B314 | pDR000007289 | GACATTCAGATGACTCAGTCTCCAGCCTCCCTA TCTGTATCTGTGGGAGAAACTGTCACCATCAC ATGTCGAGCAAGTGAAAATATTTACAGTAATT TAGCATGGTATCAGCAGAAACAGGGAAAATCT CCTCAGCTCCTGGTCTATGCTGCAACAAACTTA GCAGATGGTGTGCCATCAAGGTTCAGTGGCAG TGGATCAGGCACACAGTATTCCCTCAAGATCA ACAGCCTGCAGTCTGAAGATTTTGGGAGTTATT ACTGTCAACATTTTTGGGGTACTCCGTACACGT TCGGAGGGGGGACCAAGCTGGAAATAAAACG GGCTGATGCTGCACCGACTGTGTCCATCTTCCC ACCATCCAGTGAGCAGTTAACATCTGGAGGTG CCTCAGTCGTGTGCTTCTTGAACAACTTCTACC CCAAAGACATCAATGTCAAGTGGAAGATTGAT GGCAGTGAACGACAAAATGGCGTCCTGAACAG TTGGACTGATCAGGACAGCAAAGACAGCACCT ACAGCATGAGCAGCACCCTCACGTTGACCAAG GACGAGTATGAACGACATAACAGCTATACCTG TGAGGCCACTCACAAGACATCAACTTCACCCA TTGTCAAGAGCTTCAACAGGAATGAGTGT | 1216 |
| SM1B315 | pDR000026238 | GACATCAAGATGACCCAGAGCCCCAGCTCTAT GTACGCCAGCCTGGGCGAGCGCGTGACCATCA CATGCAAGGCCAGCCAGGACATCAACAGCTAC CTGAGCTGGTTCCAGCAGAAGCCCGGCAAGAG CCCCAAGACCCTGATCTACCGGGCCAACAGAC TGGTGGACGGCGTGCCAAGCAGATTCAGCGGC AGCGGCTCTGGCCAGGACTACAGCCTGACCAT CAGCAGCCTGGAATACGAGGACATGGGCATCT ACTACTGCCTGCAGTACGACGAGTTCCCCTAC ACCTTCGGCGGAGGCACCAAGCTGGAAATCAA GCGGGCTGATGCTGCACCGACTGTGTCCATCTT CCCACCATCCAGTGAGCAGTTAACATCTGGAG GTGCCTCAGTCGTGTGCTTCTTGAACAACTTCT ACCCCAAAGACATCAATGTCAAGTGGAAGATT GATGGCAGTGAACGACAAAATGGCGTCCTGAA CAGTTGGACTGATCAGGACAGCAAAGACAGCA | 1217 |

TABLE 48-continued

HlgA/LukE Antibody Light Chain CDSs

| mAB/Fab name | Construct ID | Light Chain CDS | SEQ ID NO: |
|---|---|---|---|
| | | CCTACAGCATGAGCAGCACCCTCACGTTGACC<br>AAGGACGAGTATGAACGACATAACAGCTATAC<br>CTGTGAGGCCACTCACAAGACATCAACTTCAC<br>CCATTGTCAAGAGCTTCAACAGGAATGAGTGT | |
| SM1B316 | pDR000029313 | GACATCCAGATGACCCAGACCACCAGCAGCCT<br>GAGCGCCAGCCTGGGCGACAGAGTGACCATCA<br>GCTGTAGCGCCTCCCAGGGCATCAGCAACTAC<br>CTGAACTGGTATCAGCAGAAACCCGACGGCAC<br>CGTGAAGCTGCTGATCCACTACACCAGCTCCCT<br>GCACAGCGGCGTGCCCAGCAGATTTTCTGGCA<br>GCGGCAGCGGCACCGACTACAGCCTGACCATC<br>TCCAACCTGGAACCCGAGGATATCGCCACCTA<br>CTACTGCCAGCAGTACAGCAAGCTGCCCTGGA<br>CCTTCGGCGGAGGCACCAAGCTGGAAATCAAG<br>CGGGCTGATGCTGCACCGACTGTGTCCATCTTC<br>CCACCATCCAGTGAGCAGTTAACATCTGGAGG<br>TGCCTCAGTCGTGTGCTTCTTGAACAACTTCTA<br>CCCCAAAGACATCAATGTCAAGTGGAAGATTG<br>ATGGCAGTGAACGACAAAATGGCGTCCTGAAC<br>AGTTGGACTGATCAGGACAGCAAAGACAGCAC<br>CTACAGCATGAGCAGCACCCTCACGTTGACCA<br>AGGACGAGTATGAACGACATAACAGCTATACC<br>TGTGAGGCCACTCACAAGACATCAACTTCACC<br>ATTGTCAAGAGCTTCAACAGGAATGAGTGT | 1218 |
| SM1B317 | pDR000029312 | GACGTGCTGATGACCCAGACCCCCCTGAGCCT<br>GCCCGTGTCTCTGGGCGATCAGGCCAGCATCA<br>GCTGCCGGTCCAGCCAGACCATCGTGTACAGC<br>GACGGCAACACCTACCTGGAATGGTATCTGCA<br>GAAGCCCGGCCAGAGCCCCAAGCTGCTGATCT<br>ACAAGGTGTCCAACCGGTTCAGCGGCGTGCCC<br>GACAGAGTGTCTGGCAGCGGCAGCGGCACCGA<br>CTTCACCCTGAAGATCAGCCGGGTGGAAGCCG<br>AGGACCTGGGCGTGTACTACTGTTTTCAGGGC<br>AGCCACGTGCCCTACACCTTCGGCGGAGGCAC<br>CAAGCTGGAAATCAAGCGGGCTGATGCTGCAC<br>CGACTGTGTCCATCTTCCCACCATCCAGTGAGC<br>AGTTAACATCTGGAGGTGCCTCAGTCGTGTGCT<br>TCTTGAACAACTTCTACCCCAAAGACATCAAT<br>GTCAAGTGGAAGATTGATGGCAGTGAACGACA<br>AAATGGCGTCCTGAACAGTTGGACTGATCAGG<br>ACAGCAAAGACAGCACCTACAGCATGAGCAGC<br>ACCCTCACGTTGACCAAGGACGAGTATGAACG<br>ACATAACAGCTATACCTGTGAGGCCACTCACA<br>AGACATCAACTTCACCCATTGTCAAGAGCTTC<br>AACAGGAATGAGTGT | 1219 |
| SM1B318 | pDR000029312 | GACGTGCTGATGACCCAGACCCCCCTGAGCCT<br>GCCCGTGTCTCTGGGCGATCAGGCCAGCATCA<br>GCTGCCGGTCCAGCCAGACCATCGTGTACAGC<br>GACGGCAACACCTACCTGGAATGGTATCTGCA<br>GAAGCCCGGCCAGAGCCCCAAGCTGCTGATCT<br>ACAAGGTGTCCAACCGGTTCAGCGGCGTGCCC<br>GACAGAGTGTCTGGCAGCGGCAGCGGCACCGA<br>CTTCACCCTGAAGATCAGCCGGGTGGAAGCCG<br>AGGACCTGGGCGTGTACTACTGTTTTCAGGGC<br>AGCCACGTGCCCTACACCTTCGGCGGAGGCAC<br>CAAGCTGGAAATCAAGCGGGCTGATGCTGCAC<br>CGACTGTGTCCATCTTCCCACCATCCAGTGAGC<br>AGTTAACATCTGGAGGTGCCTCAGTCGTGTGCT<br>TCTTGAACAACTTCTACCCCAAAGACATCAAT<br>GTCAAGTGGAAGATTGATGGCAGTGAACGACA<br>AAATGGCGTCCTGAACAGTTGGACTGATCAGG<br>ACAGCAAAGACAGCACCTACAGCATGAGCAGC<br>ACCCTCACGTTGACCAAGGACGAGTATGAACG<br>ACATAACAGCTATACCTGTGAGGCCACTCACA<br>AGACATCAACTTCACCCATTGTCAAGAGCTTC<br>AACAGGAATGAGTGT | 1220 |
| SM1B319 | pDR000029311 | GACATCGTGATGACCCAGGCCGCTCCCAGCGT<br>GCCAGTGACACCTGGCGAGAGCGTGTCCATCA<br>GCTGCAGAAGCAGCAAGAGCCTGCTGCACAGC<br>AACGGCAATACCTACCTGTACTGGTTCCTGCA | 1221 |

TABLE 48-continued

HlgA/LukE Antibody Light Chain CDSs

| mAB/Fab name | Construct ID | Light Chain CDS | SEQ ID NO: |
|---|---|---|---|
| | | GCGGCCTGGCCAGAGCCCCCAGCTGCTGATCT ACCGGATGAGCAACCTGGCCAGCGGCGTGCCC GACAGATTTTCTGGCAGCGGCAGCGGCACCGC CTTCACCCTGCGGATCAGCAGAGTGGAAGCCG AGGACGTGGGCGTGTACTACTGCATGCAGCAC CTGGAATACCCCTTCACCTTCGGCTCCGGCACC AAGCTGGAAATCAAGCGGGCTGATGCTGCACC GACTGTGTCCATCTTCCCACCATCCAGTGAGCA GTTAACATCTGGAGGTGCCTCAGTCGTGTGCTT CTTGAACAACTTCTACCCCAAAGACATCAATG TCAAGTGGAAGATTGATGGCAGTGAACGACAA AATGGCGTCCTGAACAGTTGGACTGATCAGGA CAGCAAAGACAGCACCTACAGCATGAGCAGCA CCCTCACGTTGACCAAGGACGAGTATGAACGA CATAACAGCTATACCTGTGAGGCCACTCACAA GACATCAACTTCACCCATTGTCAAGAGCTTCA ACAGGAATGAGTGT | |
| SM1B320 | pDR000007336 | GATATCCAGATGACACAGACTACATCCTCCCT GTCTGCCTCTCTGGGAGACAGAGTCACCATCA GTTGCAGTGCAAGTCAGGGCATTAGCAATTAT TTAAACTGGTATCAGCAGAAACCAGATGGAAC TGTTAAACTCCTGATCTATTACACATCAAGTTT ACACTCAGGAGTCCCATCAAGGTTCAGTGGCA GTGGGTCTGGGACAGATTATTCTCTCACCATCA GCAACCTGGAACCTGAAGATATTGCCACTTAC TATTGTCAGCAGTATAGTAAGCTTCCGTACACG TTCGGAGGGGGGACCAAGCTGGAAATAAAAC GGGCTGATGCTGCACCGACTGTGTCCATCTTCC CACCATCCAGTGAGCAGTTAACATCTGGAGGT GCCTCAGTCGTGTGCTTCTTGAACAACTTCTAC CCCAAAGACATCAATGTCAAGTGGAAGATTGA TGGCAGTGAACGACAAAATGGCGTCCTGAACA GTTGGACTGATCAGGACAGCAAAGACAGCACC TACAGCATGAGCAGCACCCTCACGTTGACCAA GGACGAGTATGAACGACATAACAGCTATACCT GTGAGGCCACTCACAAGACATCAACTTCACCC ATTGTCAAGAGCTTCAACAGGAATGAGTGT | 1222 |
| SM1B321 | pDR000027048 | GACATCCAGATGACCCAGAGCCCCGCCAGCCT GAGCGCCTCTGTGGGCGAGACAGTGACCATCA TCTGCCGGGCCAGCGAGAACATCTACAGCTAC CTGGCCTGGTATCAGCAGAAGCAGGGCAAGAG CCCCCAGCTGCTGGTGTACAACGCCAAGACCC TGGTGGAAGGCGTGCCCAGCAGATTCAGCGGC AGCGGCTCCGGCACCCAGTTCAGCCTGAAGAT CAACAGCCTGCAGCCCGAGGACTTCGGCAGCT ACTACTGCCAGCACCACTACGGCAGCCCCTAC ACCTTCGGCGAGGCACCAAGCTGGAAATCAA GCGGGCTGATGCTGCACCGACTGTGTCCATCTT CCCACCATCCAGTGAGCAGTTAACATCTGGAG GTGCCTCAGTCGTGTGCTTCTTGAACAACTTCT ACCCCAAAGACATCAATGTCAAGTGGAAGATT GATGGCAGTGAACGACAAAATGGCGTCCTGAA CAGTTGGACTGATCAGGACAGCAAAGACAGCA CCTACAGCATGAGCAGCACCCTCACGTTGACC AAGGACGAGTATGAACGACATAACAGCTATAC CTGTGAGGCCACTCACAAGACATCAACTTCAC CCATTGTCAAGAGCTTCAACAGGAATGAGTGT | 1223 |
| SM1B322 | pDR000007338 | GACATTGTGATGACCCAGTCTCACAAATTCAT GTCCACATCAGTAGGAGACAGGGTCAGCATCA CCTGCAAGGCCAGTCAGGATGTGAGTACTGCT GTAGCCTGGTATCAACAGAAACCAGGACAATC TCCTAAACTACTGATTTACTCGGCATCCTACCG GTACACTGGAGTCCCTGATCGCTTCACTGGCA GTGGATCTGGGACGGATTTCACTTTCACCATCA GCAGTGTGCAGGCTGAAGACCTGGCAGTTTAT TACTGTCAGCAACATTATAGTACTCCGTGGAC GTTCGGTGGAGGCACCAAGCTGGAAATCAAAC GGGCTGATGCTGCACCGACTGTGTCCATCTTCC CACCATCCAGTGAGCAGTTAACATCTGGAGGT GCCTCAGTCGTGTGCTTCTTGAACAACTTCTAC CCCAAAGACATCAATGTCAAGTGGAAGATTGA | 1224 |

TABLE 48-continued

HlgA/LukE Antibody Light Chain CDSs

| mAB/Fab name | Construct ID | Light Chain CDS | SEQ ID NO: |
|---|---|---|---|
| | | TGGCAGTGAACGACAAAATGGCGTCCTGAACA GTTGGACTGATCAGGACAGCAAAGACAGCACC TACAGCATGAGCAGCACCCTCACGTTGACCAA GGACGAGTATGAACGACATAACAGCTATACCT GTGAGGCCACTCACAAGACATCAACTTCACCC ATTGTCAAGAGCTTCAACAGGAATGAGTGT | |
| SM1B323 | pDR000029310 | GAGACAACCGTGACCCAGAGCCCCGCCAGCCT GAGCATGGCCATCGGCGAGAAAGTGACCATCC GGTGCATCACCAGCACCGACATCGACGACGAC ATGAACTGGTATCAGCAGAAGCCCGGCGAGCC CCCCAAGCTGCTGATCAGCGAGGGCAACACCC TGCGGCCTGGCGTGCCCAGCAGATTCAGCAGC AGCGGCTACGGCACCGACTTCGTGTTCACCAT CGAGAACATGCTGAGCGAGGACGTGGCCGACT ACTACTGCCTGCAGAGCGACAACCTGCCCTAC ACCTTCGGCGGAGGCACCAAGCTGGAAATCAA GCGGGCTGATGCTGCACCGACTGTGTCCATCTT CCCACCATCCAGTGAGCAGTTAACATCTGGAG GTGCCTCAGTCGTGTGCTTCTTGAACAACTTCT ACCCCAAAGACATCAATGTCAAGTGGAAGATT GATGGCAGTGAACGACAAAATGGCGTCCTGAA CAGTTGGACTGATCAGGACAGCAAAGACAGCA CCTACAGCATGAGCAGCACCCTCACGTTGACC AAGGACGAGTATGAACGACATAACAGCTATAC CTGTGAGGCCACTCACAAGACATCAACTTCAC CCATTGTCAAGAGCTTCAACAGGAATGAGTGT | 1225 |
| SM1B324 | pDR000029309 | GACATCGTGATGACCCAGAGCCCCAGCAGCCT GTCCGTGTCTGCCGGCGAGAAAGTGACCATGA GCTGCAAGAGCAGCCAGAGCCTGCTGAACAGC GGCAACCAGAAGAACTACCTGGCCTGGTATCA GCAGAAGCCCGGCCAGCCCCCCAAGCTGCTGA TCTACGGCGCCAGCACCAGAGAAAGCGGCGTG CCCGACAGATTCACCGGCAGCGGCTCCGGCAC CGACTTCACCCTGACCATCAGCAGCGTGCAGG CCGAGGACCTGGCCGTGTACTACTGCCAGAAC GACCACAGCTACCCCCCACCTTCGGCGGAGG CACCAAGCTGGAAATCAAGCGGGCTGATGCTG CACCGACTGTGTCCATCTTCCCACCATCCAGTG AGCAGTTAACATCTGGAGGTGCCTCAGTCGTG TGCTTCTTGAACAACTTCTACCCCAAAGACATC AATGTCAAGTGGAAGATTGATGGCAGTGAACG ACAAAATGGCGTCCTGAACAGTTGGACTGATC AGGACAGCAAAGACAGCACCTACAGCATGAG CAGCACCCTCACGTTGACCAAGGACGAGTATG AACGACATAACAGCTATACCTGTGAGGCCACT CACAAGACATCAACTTCACCCATTGTCAAGAG CTTCAACAGGAATGAGTGT | 1226 |
| SM1B325 | pDR000029308 | GACATCCAGATGACCCAGAGCCCCAGCAGCCT GAGCGCCAGCCTGGGCGAGAGAGTGTCCCTGA CCTGCCGGGCCAGCCAGGACATCGGCAACAGC CTGAACTGGCTGCAGCAGAAGCCCGACGGCAC CATCAAGCGGCTGATCTACGCCACCAGCAACC TGGACAGCGGCGTGCCCAAGCGGTTCAGCGGC AGCAGATCCGGCAGCGACTACAGCCTGACCAT CAGCAGCCTGGAAAGCGAGGACTTCGTGAACT ACTACTGCCTGCAGTTCGCCAGCAGCCCCCTG ACCTTCGGCACCGGCACCAAGCTGGAAATCAA GCGGGCTGATGCTGCACCGACTGTGTCCATCTT CCCACCATCCAGTGAGCAGTTAACATCTGGAG GTGCCTCAGTCGTGTGCTTCTTGAACAACTTCT ACCCCAAAGACATCAATGTCAAGTGGAAGATT GATGGCAGTGAACGACAAAATGGCGTCCTGAA CAGTTGGACTGATCAGGACAGCAAAGACAGCA CCTACAGCATGAGCAGCACCCTCACGTTGACC AAGGACGAGTATGAACGACATAACAGCTATAC CTGTGAGGCCACTCACAAGACATCAACTTCAC CCATTGTCAAGAGCTTCAACAGGAATGAGTGT | 1227 |
| SM1B326 | pDR000007289 | GACATTCAGATGACTCAGTCTCCAGCCTCCCTA TCTGTATCTGTGGGAGAAACTGTCACCATCAC ATGTCGAGCAAGTGAAAATATTTACAGTAATT | 1228 |

TABLE 48-continued

HlgA/LukE Antibody Light Chain CDSs

| mAB/Fab name | Construct ID | Light Chain CDS | SEQ ID NO: |
|---|---|---|---|
| | | TAGCATGGTATCAGCAGAAACAGGGAAAATCT CCTCAGCTCCTGGTCTATGCTGCAACAAACTTA GCAGATGGTGTGCCATCAAGGTTCAGTGGCAG TGGATCAGGCACACAGTATTCCCTCAAGATCA ACAGCCTGCAGTCTGAAGATTTTGGGAGTTATT ACTGTCAACATTTTTGGGGTACTCCGTACACGT TCGGAGGGGGGACCAAGCTGGAAATAAAACG GGCTGATGCTGCACCGACTGTGTCCATCTTCCC ACCATCCAGTGAGCAGTTAACATCTGGAGGTG CCTCAGTCGTGTGCTTCTTGAACAACTTCTACC CCAAAGACATCAATGTCAAGTGGAAGATTGAT GGCAGTGAACGACAAAATGGCGTCCTGAACAG TTGGACTGATCAGGACAGCAAAGACAGCACCT ACAGCATGAGCAGCACCCTCACGTTGACCAAG GACGAGTATGAACGACATAACAGCTATACCTG TGAGGCCACTCACAAGACATCAACTTCACCCA TTGTCAAGAGCTTCAACAGGAATGAGTGT | |
| SM1B327 | pDR000029307 | CAGATCGTGCTGACCCAGAGCCCCGCCATCAT GAGCGCCAGCCCTGGCGAGAAAGTGACCATGA CCTGCAGCGCCAGCAGCAACGTGTCCTACATG CACTGGTTCCAGCAGAAGTCCGGCACCAGCCC CAAGCGGTGGATCTACGACACCAGCAAGCTGG CCAGCGGCGTGCCCGCCAGATTTTCTGGCAGC GGCAGCGGCACCAGCTACAGCCTGACCGTGTC CAGCATGGAAGCCGAGGACGCCGCCACCTACT ACTGCCAGCAGTGGTCCAGCAACCCCCGGACC TTCGGCGGAGGCACCAAGCTGGAAATCAAGCG GGCTGATGCTGCACCGACTGTGTCCATCTTCCC ACCATCCAGTGAGCAGTTAACATCTGGAGGTG CCTCAGTCGTGTGCTTCTTGAACAACTTCTACC CCAAAGACATCAATGTCAAGTGGAAGATTGAT GGCAGTGAACGACAAAATGGCGTCCTGAACAG TTGGACTGATCAGGACAGCAAAGACAGCACCT ACAGCATGAGCAGCACCCTCACGTTGACCAAG GACGAGTATGAACGACATAACAGCTATACCTG TGAGGCCACTCACAAGACATCAACTTCACCCA TTGTCAAGAGCTTCAACAGGAATGAGTGT | 1229 |
| SM1B328 | pDR000027029 | GACATCCAGATGACCCAGAGCCCCAGCAGCCT GAGCGCCAGCCTGGGCGAGAGAGTGTCCCTGA CCTGCCGGGCCAGCCAGGACATCGGCAGCTAC CTGAACTGGCTGCAGCAGGAACCCGACGGCAC CATCAAGCGGCTGATCTACGCCACCAGCTCCC TGGACAGCGGCGTGCCCAAGCGGTTCAGCGGC AGCAGATCTGGCGCCGACTACAGCCTGACCAT CAGCAGCCTGGAAAGCGAGGACTTCGTGGACT ACTACTGCCTGCAGTACGCCACCTCCCCCTGGA CCTTCGGCGGAGGCACCAAGCTGGAAATCAAG CGGGCTGATGCTGCACCGACTGTGTCCATCTTC CCACCATCCAGTGAGCAGTTAACATCTGGAGG TGCCTCAGTCGTGTGCTTCTTGAACAACTTCTA CCCCAAAGACATCAATGTCAAGTGGAAGATTG ATGGCAGTGAACGACAAAATGGCGTCCTGAAC AGTTGGACTGATCAGGACAGCAAAGACAGCAC CTACAGCATGAGCAGCACCCTCACGTTGACCA AGGACGAGTATGAACGACATAACAGCTATACC TGTGAGGCCACTCACAAGACATCAACTTCACC CATTGTCAAGAGCTTCAACAGGAATGAGTGT | 1230 |
| SM1B329 | pDR000029306 | GACATCCAGATGACCCAGAGCAGCAGCTACCT GAGCGTGTCCCTGGGCGGCAGAGTGACCATCA CATGCAAGGCCAGCGACCACATCAACAACTGG CTGGCCTGGTATCAGCAGAAGCCCGGCAACGC CCCCAGACTGCTGATCAGCGGCGCCACCAGCC TGGAAACCGGCGTGCCAAGCAGATTCAGCGGC AGCGGCTCCGGCAAGGACTACACCCTGAGCAT CACCAGCCTGCAGACCGAGGACGTGGCCACCT ACTACTGCCAGCAGTACTGGTCCACCCCCTAC ACCTTCGGCGGAGGCACCAAGCTGGAAATCAA GCGGGCTGATGCTGCACCGACTGTGTCCATCTT CCCACCATCCAGTGAGCAGTTAACATCTGGAG GTGCCTCAGTCGTGTGCTTCTTGAACAACTTCT ACCCCAAAGACATCAATGTCAAGTGGAAGATT | 1231 |

TABLE 48-continued

HlgA/LukE Antibody Light Chain CDSs

| mAB/Fab name | Construct ID | Light Chain CDS | SEQ ID NO: |
|---|---|---|---|
| | | GATGGCAGTGAACGACAAAATGGCGTCCTGAA CAGTTGGACTGATCAGGACAGCAAAGACAGCA CCTACAGCATGAGCAGCACCCTCACGTTGACC AAGGACGAGTATGAACGACATAACAGCTATAC CTGTGAGGCCACTCACAAGACATCAACTTCAC CCATTGTCAAGAGCTTCAACAGGAATGAGTGT | |
| M1B330 | pDR000029305 | CAGATCGTGCTGACCCAGAGCCCTGCCCTGAT GAGCGCCAGCCCTGGCGAGAAAGTGACCATGA CCTGCAGCGCCAGCAGCAGCGTGTCCTACATG TACTGGTATCAGCAGAAGCCCAGAAGCAGCCC CAAGCTGAAGTACGCCAGCAACCTGGCCAGCG GCGTGCCCGCCAGATTTTCTGGCAGCGGCAGC GGCACCAGCTACAGCCTGACCATCAGCAGCAT GGAAGCCGAGGACGCCGCCACCTACTACTGCC AGCAGTGGTCCAGCAACCCCCCCATCACCTTC GGAGCCGGCACCAAGCTGGAACTGAAGCGGG CTGATGCTGCACCGACTGTGTCCATCTTCCCAC CATCCAGTGAGCAGTTAACATCTGGAGGTGCC TCAGTCGTGTGCTTCTTGAACAACTTCTACCCC AAAGACATCAATGTCAAGTGGAAGATTGATGG CAGTGAACGACAAAATGGCGTCCTGAACAGTT GGACTGATCAGGACAGCAAAGACAGCACCTAC AGCATGAGCAGCACCCTCACGTTGACCAAGGA CGAGTATGAACGACATAACAGCTATACCTGTG AGGCCACTCACAAGACATCAACTTCACCCATT GTCAAGAGCTTCAACAGGAATGAGTGT | 1232 |
| SM1B331 | pDR000027141 | GACATCGTGATGACCCAGAGCCCCGCCACCCT GAGCGTGACCCCTGGCGATAGAGTGTCCCTGA GCTGCCGGGCCAGCCAGAGCATCAGCGACTAC CTGCACTGGTATCAGCAGAAGTCCCACGAGAG CCCCAGACTGCTGATTAAGTACGACAGCCAGT CCATCAGCGGCATCCCCAGCAGATTCAGCGGC AGCGGCTCCGGCTCCGACTTCACCCTGAGCAT CAACAGCGTGGAACCCGAGGACGTGGGCGTGT ACTACTGCCAGAACGGCACCGGTTCCCTTTCA CCTTCGGCGGAGGCACCAAGCTGGAAATCAAG CGGGCTGATGCTGCACCGACTGTGTCCATCTTC CCACCATCCAGTGAGCAGTTAACATCTGGAGG TGCCTCAGTCGTGTGCTTCTTGAACAACTTCTA CCCCAAAGACATCAATGTCAAGTGGAAGATTG ATGGCAGTGAACGACAAAATGGCGTCCTGAAC AGTTGGACTGATCAGGACAGCAAAGACAGCAC CTACAGCATGAGCAGCACCCTCACGTTGACCA AGGACGAGTATGAACGACATAACAGCTATACC TGTGAGGCCACTCACAAGACATCAACTTCACC CATTGTCAAGAGCTTCAACAGGAATGAGTGT | 1233 |
| SM1B332 | pDR000029304 | CAGATCGTGCTGACCCAGAGCCCCGCCATCAT GAGCGCCAGCCCTGGCGAGAAAGTGACCCTGA CCTGCAGCGCCAGCAGCAGCGTGTCCAGCAGC TACCTGTTCTGGTATCAGCAGAAGCCCGGCAG CAGCCCCAAGCTGTGGATCTACAGCACCAGCA ACCTGGCCAGCGGCGTGCCCGTGCGGTTTAGC GGCAGCGGCTTTGGCACCAGCTACAGCCTGAC CATCAGCCGGATGGAAGCCGAGGACGCCGCCA GCTACTTCTGCCACCAGTGGTCCAGCTACCCCC CCACCTTCGGAGCCGGCACCAAGCTGGAACTG AAGCGGGCTGATGCTGCACCGACTGTGTCCAT CTTCCCACCATCCAGTGAGCAGTTAACATCTGG AGGTGCCTCAGTCGTGTGCTTCTTGAACAACTT CTACCCCAAAGACATCAATGTCAAGTGGAAGA TTGATGGCAGTGAACGACAAAATGGCGTCCTG AACAGTTGGACTGATCAGGACAGCAAAGACAG CACCTACAGCATGAGCAGCACCCTCACGTTGA CCAAGGACGAGTATGAACGACATAACAGCTAT ACCTGTGAGGCCACTCACAAGACATCAACTTC ACCCATTGTCAAGAGCTTCAACAGGAATGAGT GT | 1234 |
| SM1B333 | pDR000029303 | GACATCGTGCTGACCCAGAGCCCTGCCAGCCT GGCCGTGTCTCTGGGCCAGAGAGCCACCATCA GCTGCCGGGCCAGCGAGAGCGTGGACAGCTAC | 1235 |

TABLE 48-continued

HlgA/LukE Antibody Light Chain CDSs

| mAB/Fab name | Construct ID | Light Chain CDS | SEQ ID NO: |
|---|---|---|---|
| | | GGCAACAGCTTCATGCACTGGTATCAGCAGAA GCCCGGCCAGCCCCCCAAGCTGCTGATCTACC TGGCCAGCAACCTGGAAAGCGGCGTGCCCGCC AGATTCAGCGGCAGCGGCAGCAGAACCGACTT CACCCTGACCATCGACCCCGTGGAAGCCGACG ACGCCGCCACCTACTACTGCCAGCAGAACAAC GAGGACCCCTACACCTTCGGCGGAGGCACCAA GCTGGAAATCAAGCGGGCTGATGCTGCACCGA CTGTGTCCATCTTCCCACCATCCAGTGAGCAGT TAACATCTGGAGGTGCCTCAGTCGTGTGCTTCT TGAACAACTTCTACCCCAAAGACATCAATGTC AAGTGGAAGATTGATGGCAGTGAACGACAAA ATGGCGTCCTGAACAGTTGGACTGATCAGGAC AGCAAAGACAGCACCTACAGCATGAGCAGCAC CCTCACGTTGACCAAGGACGAGTATGAACGAC ATAACAGCTATACCTGTGAGGCCACTCACAAG ACATCAACTTCACCCATTGTCAAGAGCTTCAAC AGGAATGAGTGT | |
| SM1B334 | pDR000029302 | GACGTGCTGATGACCCAGACCCCCCTGAGCCT GCCCGTGTCTCTGGGCGATCAGGCCAGCATCA GCTGCCGGTCCAGCCAGAGCATCGTGTACAGC AACGGCAACACCTACCTGGACTGGTATCTGCA GAAGCCCGGCCAGCCCCCAAGCTGCTGATCT ACAAGGTGTCCAACCGGTTCAGCGGCGTGCCC GACAGATTCAGCGGCAGCGGCTCCGGCACCGA CTTCATCCTGAAGATCAGCCGGGTGGAAGCCG AGGACCTGGGCGTGTACTACTGTTTTCAGGGC AGCCACGTGCCCTGGACCTTCGGCGGAGGCAC CAAGCTGGAAATCAAGCGGGCTGATGCTGCAC CGACTGTGTCCATCTTCCCACCATCCAGTGAGC AGTTAACATCTGGAGGTGCCTCAGTCGTGTGCT TCTTGAACAACTTCTACCCCAAAGACATCAAT GTCAAGTGGAAGATTGATGGCAGTGAACGACA AAATGGCGTCCTGAACAGTTGGACTGATCAGG ACAGCAAAGACAGCACCTACAGCATGAGCAGC ACCCTCACGTTGACCAAGGACGAGTATGAACG ACATAACAGCTATACCTGTGAGGCCACTCACA AGACATCAACTTCACCCATTGTCAAGAGCTTC AACAGGAATGAGTGT | 1236 |
| SM1B335 | pDR000029301 | GACGTGGTGGTCACCCAGACCCCCCTGAGCCT GCCCGTGTCCTTCGGCGACCAGGTGTCCATCA GCTGCAGAAGCAGCCAGAGCCTGGCCAACAGC TACGGCAACACCTACCTGAGCTGGTATCTGCA CAAGCCCGGCCAGAGCCCCCAGCTGCTGATCT ACGGCATCAGCAACCGGTTCAGCGGCGTGCCC GACAGATTCAGCGGCAGCGGCTCCGGCACCGA CTTCACCCTGAAGATCAGCACCATCAAGCCCG AGGACCTGGGCATGTACTACTGTCTGCAGGGC ACCCACCAGCCCTACACCTTCGGCGGAGGCAC CAAGCTGGAAATCAAGCGGGCTGATGCTGCAC CGACTGTGTCCATCTTCCCACCATCCAGTGAGC AGTTAACATCTGGAGGTGCCTCAGTCGTGTGCT TCTTGAACAACTTCTACCCCAAAGACATCAAT GTCAAGTGGAAGATTGATGGCAGTGAACGACA AAATGGCGTCCTGAACAGTTGGACTGATCAGG ACAGCAAAGACAGCACCTACAGCATGAGCAGC ACCCTCACGTTGACCAAGGACGAGTATGAACG ACATAACAGCTATACCTGTGAGGCCACTCACA AGACATCAACTTCACCCATTGTCAAGAGCTTC AACAGGAATGAGTGT | 1237 |
| SM1B336 | pDR000029300 | GACATCGTGATGAGCCAGAGCCCCAGCAGCCT GGCCGTGTCCGTGGGCGAGAAAGTGACCATGA GCTGCAAGAGCAGCCAGAGCGTGCTGTACAAC AGCAACCAGCGGAACTACCTGGCCTGGTATCA GCAGAAGCCCGGCCAGTCCCCCAAGCTGCTGA TCTACTGGGCCAGCACCCGCGAGAGCGGCGTG CCAGATAGAAGCACAGGCAGCGGCAGCGGCA CCGACTTCACCCTGACCATCAGCAGCGTGCAG GCCGAGGATCTGGCCGTGTACTACTGCCACCA GTACCTGAGCAGCTACACCTTCGGCGGAGGCA CCAAGCTGGAAATCAAGCGGGCTGATGCTGCA | 1238 |

TABLE 48-continued

HlgA/LukE Antibody Light Chain CDSs

| mAB/Fab name | Construct ID | Light Chain CDS | SEQ ID NO: |
|---|---|---|---|
| | | CCGACTGTGTCCATCTTCCCACCATCCAGTGAG CAGTTAACATCTGGAGGTGCCTCAGTCGTGTG CTTCTTGAACAACTTCTACCCCAAAGACATCAA TGTCAAGTGGAAGATTGATGGCAGTGAACGAC AAAATGGCGTCCTGAACAGTTGGACTGATCAG GACAGCAAAGACAGCACCTACAGCATGAGCA GCACCCTCACGTTGACCAAGGACGAGTATGAA CGACATAACAGCTATACCTGTGAGGCCACTCA CAAGACATCAACTTCACCCATTGTCAAGAGCT TCAACAGGAATGAGTGT | |
| SM1B337 | pDR000029299 | GACATCGTGATGACCCAGAGCCACAAGTTCAT GAGCACCAGCGTGGGCGACCGGGTGTCCATCA CATGCAAGGCCAGCCAGGACGTGGGCACCGCC GTGGCCTGGTATCAGCAGAAGCCCGGCCAGAG CCCCAAGCTGCTGATCTACTGGGCCAGCACCA GACACACCGGCGTGCCCGACAGATTCACAGGC AGCGGCAGCGGCACCGACTTCACCCTGACCAT CAGCAACGTGCAGAGCGAGGACCTGGCCGACT ACTTCTGCCAGCAGTACAGCAGCTACCCCCTG ACCTTCGGAGCCGGCACCAAGCTGGAACTGAA GCGGGCTGATGCTGCACCGACTGTGTCCATCTT CCCACCATCCAGTGAGCAGTTAACATCTGGAG GTGCCTCAGTCGTGTGCTTCTTGAACAACTTCT ACCCCAAAGACATCAATGTCAAGTGGAAGATT GATGGCAGTGAACGACAAAATGGCGTCCTGAA CAGTTGGACTGATCAGGACAGCAAAGACAGCA CCTACAGCATGAGCAGCACCCTCACGTTGACC AAGGACGAGTATGAACGACATAACAGCTATAC CTGTGAGGCCACTCACAAGACATCAACTTCAC CCATTGTCAAGAGCTTCAACAGGAATGAGTGT | 1239 |
| SM1B338 | pDR000029319 | GACATCGTGCTGACCCAGAGCCCTGCCAGCCT GGCCGTGTCTCTGGGCCAGAGAGCCACCATCA GCTGCCGGGCCAGCGAGAGCGTGGACAGCTAC GGCAACAGCTTCATGCACTGGTATCAGCAGAA GCCCGGCCAGCCCCCCAAGCTGCTGATCTACC GGGCCAGCAACCTGGAAAGCGGCATCCCCGCC AGATTCAGCGGCAGCGGCAGCCGGACCGACTT CACCCTGACCATCAACCCCGTGGAAGCCGACG ACGTGGCCACCTACTACTGCCAGCAGAGCAAC GAGGACCCCCCCTGGACCTTCGGCGGAGGCAC CAAGCTGGAAATCAAGCGGGCTGATGCTGCAC CGACTGTGTCCATCTTCCCACCATCCAGTGAGC AGTTAACATCTGGAGGTGCCTCAGTCGTGTGCT TCTTGAACAACTTCTACCCCAAAGACATCAAT GTCAAGTGGAAGATTGATGGCAGTGAAC AAAATGGCGTCCTGAACAGTTGGACTGATCAGG ACAGCAAAGACAGCACCTACAGCATGAGCAGC ACCCTCACGTTGACCAAGGACGAGTATGAACG ACATAACAGCTATACCTGTGAGGCCACTCACA AGACATCAACTTCACCCATTGTCAAGAGCTTC AACAGGAATGAGTGT | 1240 GACA |
| SM1B339 | pDR000029319 | GACATCGTGCTGACCCAGAGCCCTGCCAGCCT GGCCGTGTCTCTGGGCCAGAGAGCCACCATCA GCTGCCGGGCCAGCGAGAGCGTGGACAGCTAC GGCAACAGCTTCATGCACTGGTATCAGCAGAA GCCCGGCCAGCCCCCCAAGCTGCTGATCTACC GGGCCAGCAACCTGGAAAGCGGCATCCCCGCC AGATTCAGCGGCAGCGGCAGCCGGACCGACTT CACCCTGACCATCAACCCCGTGGAAGCCGACG ACGTGGCCACCTACTACTGCCAGCAGAGCAAC GAGGACCCCCCCTGGACCTTCGGCGGAGGCAC CAAGCTGGAAATCAAGCGGGCTGATGCTGCAC CGACTGTGTCCATCTTCCCACCATCCAGTGAGC AGTTAACATCTGGAGGTGCCTCAGTCGTGTGCT TCTTGAACAACTTCTACCCCAAAGACATCAAT GTCAAGTGGAAGATTGATGGCAGTGAACGACA AAATGGCGTCCTGAACAGTTGGACTGATCAGG ACAGCAAAGACAGCACCTACAGCATGAGCAGC ACCCTCACGTTGACCAAGGACGAGTATGAACG ACATAACAGCTATACCTGTGAGGCCACTCACA | 1241 |

TABLE 48-continued

HlgA/LukE Antibody Light Chain CDSs

| mAB/Fab name | Construct ID | Light Chain CDS | SEQ ID NO: |
|---|---|---|---|
| | | AGACATCAACTTCACCCATTGTCAAGAGCTTC AACAGGAATGAGTGT | |
| SM1B340 | pDR000029298 | GACATCCAGATGACCCAGACCACCAGCAGCCT GAGCGCCAGCCTGGGCGACAGAGTGACCATCA GCTGCCGGGCCAGCCAGGACATCGACAACTAC CTGAACTGGTATCAGCAGAAACCCGACGGCAC CGTGAAGCTGCTGATCAGCTACACCAGCCGGC TGCACAGCGGCGTGCCCAGCAGATTTTCTGGC AGCGGCAGCGGCACCGACTACAGCCTGACCAT CTCCAACCTGGAACAGGAAGATTTCGCTACCT ACTTCTGTCAGCAGGGCTACACCCTGCCCTGG ACCTTCGGCGGAGGCACCAAGCTGGAAATCAA GCGGGCTGATGCTGCACCGACTGTGTCCATCTT CCCACCATCCAGTGAGCAGTTAACATCTGGAG GTGCCTCAGTCGTGTGCTTCTTGAACAACTTCT ACCCCAAAGACATCAATGTCAAGTGGAAGATT GATGGCAGTGAACGACAAAATGGCGTCCTGAA CAGTTGGACTGATCAGGACAGCAAAGACAGCA CCTACAGCATGAGCAGCACCCTCACGTTGACC AAGGACGAGTATGAACGACATAACAGCTATAC CTGTGAGGCCACTCACAAGACATCAACTTCAC CCATTGTCAAGAGCTTCAACAGGAATGAGTGT | 1242 |

TABLE 49

HlgA/LukE Antibody Light Chain Primary Transcripts

| mAB/Fab name | Construct ID | Light Chain Primary Transcript | SEQ ID NO: |
|---|---|---|---|
| SM1B302 | pDR000027850 | ATGGAGACACATTCTCAGGTCTTTGTATACATG TTGCTGTGGTTGTCTGGTGTCGAGGGCGACATC CAGATGACCCAGAGCCCTAGCAGCCTGAGCGC CTCTCTGGGCGAGAGAGTGTCCCTGACCTGCA GAGCCAGCCAGGACATCGGCAGCTCCCTGAAC TGGCTGCAGCAGGAACCCGACGGCACCATCAA GCGGCTGATCTACGCCACCAGCAGCCTGGATA GCGGCGTGCCCAAGAGATTCAGCGGCAGCAGA AGCGGCAGCGACTACAGCCTGACCATCTCCAG CCTGGAATCCGAGGACTTCGTGGACTACTACT GCCTGCAGTACGCCAGCAGCCCCTGGACCTTT GGCGGAGGCACCAAGCTGGAAATCAAGCGGG CTGATGCTGCACCGACTGTGTCCATCTTCCCAC CATCCAGTGAGCAGTTAACATCTGGAGGTGCC TCAGTCGTGTGCTTCTTGAACAACTTCTACCCC AAAGACATCAATGTCAAGTGGAAGATTGATGG CAGTGAACGACAAAATGGCGTCCTGAACAGTT GGACTGATCAGGACAGCAAAGACAGCACCTAC AGCATGAGCAGCACCCTCACGTTGACCAAGGA CGAGTATGAACGACATAACAGCTATACCTGTG AGGCCACTCACAAGACATCAACTTCACCCATT GTCAAGAGCTTCAACAGGAATGAGTGTTAG | 1243 |
| SM1B303 | pDR000029323 | ATGGAGACACATTCTCAGGTCTTTGTATACATG TTGCTGTGGTTGTCTGGTGTCGAGGGCGACATC CAGATGACCCAGACCACCAGCAGCCTGAGCGC CAGCCTGGGCGACAGAGTGACCATCAGCTGCT GGGCCAGCCAGGACATCAGAAGCTACCTGAAC TGGTATCAGCAGAAACCCGACGGCACCGTGAA GCTGCTGATCTACTACACCAGCCGGCTGCACA GCGGCGTGCCCAGCAGATTTTCTGGCAGCGGC AGCGGCACCGACTTCAGCCTGACCATCTCCAA CCTGGAACAGGAAGATATCGCTACCTACTTCT GTCAGCAGGGCAACACCCTGCCCTACACCTTC GGCGGAGGCACCAAGCTGGAAATCAAGCGGG CTGATGCTGCACCGACTGTGTCCATCTTCCCAC CATCCAGTGAGCAGTTAACATCTGGAGGTGCC TCAGTCGTGTGCTTCTTGAACAACTTCTACCCC AAAGACATCAATGTCAAGTGGAAGATTGATGG | 1244 |

TABLE 49-continued

HlgA/LukE Antibody Light Chain Primary Transcripts

| mAB/Fab name | Construct ID | Light Chain Primary Transcript | SEQ ID NO: |
|---|---|---|---|
| | | CAGTGAACGACAAAATGGCGTCCTGAACAGTT GGACTGATCAGGACAGCAAAGACAGCACCTAC AGCATGAGCAGCACCCTCACGTTGACCAAGGA CGAGTATGAACGACATAACAGCTATACCTGTG AGGCCACTCACAAGACATCAACTTCACCCATT GTCAAGAGCTTCAACAGGAATGAGTGTTAG | |
| SM1B304 | pDR000029322 | ATGGAGACACATTCTCAGGTCTTTGTATACATG TTGCTGTGGTTGTCTGGTGTCGAGGGCGACATC CAGATGACCCAGAGCCCCAGCAGCCTGAGCGC CAGCCTGGGCGAGAGTGTCCCTGACCTGCC GGGCCAGCCAGGAAATCAGCGGCTACCTGAGC TGGCTGCAGCAGAAGCCCGACGGCACCATCAA GCGGCTGATCTACGCCGCCAGCACCCTGGACA GCGGCGTGCCCAAGAGATTCAGCGGCAGCCGC AGCGGCAGCGACTACAGCCTGACCATCAGCAG CCTGGAAAGCGAGGACTTCGCCGACTACTACT GCCTGCAGTACGCCAGCTACCCCCGGACCTTC GGCGGAGGCACCAAGCTGGAAATCAAGCGGG CTGATGCTGCACCGACTGTGTCCATCTTCCCAC CATCCAGTGAGCAGTTAACATCTGGAGGTGCC TCAGTCGTGTGCTTCTTGAACAACTTCTACCCC AAAGACATCAATGTCAAGTGGAAGATTGATGG CAGTGAACGACAAAATGGCGTCCTGAACAGTT GGACTGATCAGGACAGCAAAGACAGCACCTAC AGCATGAGCAGCACCCTCACGTTGACCAAGGA CGAGTATGAACGACATAACAGCTATACCTGTG AGGCCACTCACAAGACATCAACTTCACCCATT GTCAAGAGCTTCAACAGGAATGAGTGTTAG | 1245 |
| SM1B305 | pDR000029321 | ATGGAGACACATTCTCAGGTCTTTGTATACATG TTGCTGTGGTTGTCTGGTGTCGAGGGCGACGTG CTGATGACCCAGACCCCCCTGAGCCTGCCCGT GTCTCTGGGCGATCAGGCCAGCATCAGCTGCC GGTCCAGCCAGATCATCGTGCACAGCAACGGC AACACCTACCTGGACTGGTATCTGCAGAAGCC CGGCCAGAGCCCCAAGCTGCTGATCTACAAGA TCAGCAACCGGTTCAGCGGCGTGCCCGACAGA TTCAGCGGCAGCGGCTCCGGCACCGACTTCAC CCTGAAGATCAGCCGGGTGGAAGCCGAGGACC TGGGCGTGTACTACTGTTTTCAGGGCAGCCAC GTGCCCTGGACCTTCGGCGGAGGCACCAAGCT GGAAATCAAGCGGGCTGATGCTGCACCGACTG TGTCCATCTTCCCACCATCCAGTGAGCAGTTAA CATCTGGAGGTGCCTCAGTCGTGTGCTTCTTGA ACAACTTCTACCCAAAGACATCAATGTCAAG TGGAAGATTGATGGCAGTGAACGACAAAATGG CGTCCTGAACAGTTGGACTGATCAGGACAGCA AAGACAGCACCTACAGCATGAGCAGCACCCTC ACGTTGACCAAGGACGAGTATGAACGACATAA CAGCTATACCTGTGAGGCCACTCACAAGACAT CAACTTCACCCATTGTCAAGAGCTTCAACAGG AATGAGTGTTAG | 1246 |
| SM1B306 | pDR000029320 | ATGGAGACACATTCTCAGGTCTTTGTATACATG TTGCTGTGGTTGTCTGGTGTCGAGGGCGACGTG GTGGTCACCCAGACCCCCCTGAGCCTGCCCGT GTCCTTCGGCGACCAGGTGTCCATCAGCTGCA GAAGCAGCCAGAGCCTGGCCAACAGCTACGGC AACACCTACCTGAGCTGGTATCTGCACAAGCC CGGCCAGAGCCCCCAGCTGCTGATCTACGGCA TCAGCAACCGGTTCAGCGGCGTGCCCGACAGA TTCAGCGGCAGCGGCTCCGGCACCGACTTCAC CCTGAAGATCAGCACCATCAAGCCCGAGGGCC TGGGCATGTACTACTGTCTGCAGGGCACCCAC CAGCCCCCCACCTTTGGCGCTGGCACCAAGCT GGAACTGAAGCGGGCTGATGCTGCACCGACTG TGTCCATCTTCCCACCATCCAGTGAGCAGTTAA CATCTGGAGGTGCCTCAGTCGTGTGCTTCTTGA ACAACTTCTACCCAAAGACATCAATGTCAAG TGGAAGATTGATGGCAGTGAACGACAAAATGG CGTCCTGAACAGTTGGACTGATCAGGACAGCA AAGACAGCACCTACAGCATGAGCAGCACCCTC ACGTTGACCAAGGACGAGTATGAACGACATAA | 1247 |

TABLE 49-continued

HlgA/LukE Antibody Light Chain Primary Transcripts

| mAB/Fab name | Construct ID | Light Chain Primary Transcript | SEQ ID NO: |
| --- | --- | --- | --- |
| | | CAGCTATACCTGTGAGGCCACTCACAAGACAT CAACTTCACCCATTGTCAAGAGCTTCAACAGG AATGAGTGTTAG | |
| SM1B307 | pDR000029319 | ATGGAGACACATTCTCAGGTCTTTGTATACATG TTGCTGTGGTTGTCTGGTGTCGAGGGCGACATC GTGCTGACCCAGAGCCCTGCCAGCCTGGCCGT GTCTCTGGGCCAGAGAGCCACCATCAGCTGCC GGGCCAGCGAGAGCGTGGACAGCTACGGCAA CAGCTTCATGCACTGGTATCAGCAGAAGCCCG GCCAGCCCCCCAAGCTGCTGATCTACCGGGCC AGCAACCTGGAAAGCGGCATCCCCGCCAGATT CAGCGGCAGCGGCAGCCGGACCGACTTCACCC TGACCATCAACCCCGTGGAAGCCGACGACGTG GCCACCTACTACTGCCAGCAGAGCAACGAGGA CCCCCCCTGGACCTTCGGCGGAGGCACCAAGC TGGAAATCAAGCGGGCTGATGCTGCACCGACT GTGTCCATCTTCCCACCATCCAGTGAGCAGTTA ACATCTGGAGGTGCCTCAGTCGTGTGCTTCTTG AACAACTTCTACCCCAAAGACATCAATGTCAA GTGGAAGATTGATGGCAGTGAACGACAAAATG GCGTCCTGAACAGTTGGACTGATCAGGACAGC AAAGACAGCACCTACAGCATGAGCAGCACCCT CACGTTGACCAAGGACGAGTATGAACGACATA ACAGCTATACCTGTGAGGCCACTCACAAGACA TCAACTTCACCCATTGTCAAGAGCTTCAACAG GAATGAGTGTTAG | 1248 |
| SM1B308 | pDR000029318 | ATGGAGACACATTCTCAGGTCTTTGTATACATG TTGCTGTGGTTGTCTGGTGTCGAGGGCGACATC GTGATGAGCCAGAGCCCCAGCCAGCCTGGCCGT GTCTGCCGGCGAGAAAGTGACCATGAGCTGCA AGAGCAGCCAGAGCCTGCTGAACAGCCGGACC CGGAAGAACTACCTGGCCTGGTATCAGCAGAA GCCCGGCCAGTCCCCCAAGCTGCTGATCTACT GGGCCAGCACCCGCGAGAGCGGCGTGCCCGAT AGATTCACAGGCAGCGGCAGCGGCACCGACTT CACCCTGACCATCAGCAGCGTGCAGGCCGAGG ATCTGGCCGTGTACTACTGCAAGCAGAGCTAC AACCTGTGGACCTTCGGCGGAGGCACCAAGCT GGAAATCAAGCGGGCTGATGCTGCACCGACTG TGTCCATCTTCCCACCATCCAGTGAGCAGTTAA CATCTGGAGGTGCCTCAGTCGTGTGCTTCTTGA ACAACTTCTACCCCAAAGACATCAATGTCAAG TGGAAGATTGATGGCAGTGAACGACAAAATGG CGTCCTGAACAGTTGGACTGATCAGGACAGCA AAGACAGCACCTACAGCATGAGCAGCACCCTC ACGTTGACCAAGGACGAGTATGAACGACATAA CAGCTATACCTGTGAGGCCACTCACAAGACAT CAACTTCACCCATTGTCAAGAGCTTCAACAGG AATGAGTGTTAG | 1249 |
| SM1B309 | pDR000029317 | ATGGAGACACATTCTCAGGTCTTTGTATACATG TTGCTGTGGTTGTCTGGTGTCGAGGGCGACGTG GTCATGACCCAGACCCCCCTGAGCCTGCCCGT GTCTCTGGGCGATCAGGCCAGCATCAGCTGCA GAAGCAGCCAGAGCCTGCTGCACAGCAACGGC AAGACCTACCTGCACTGGTATCTGCAGAAGCC CGGCCAGAGCCCCAAGCTGCTGATCTACAAGG TGTCCAACCGGTTCAGCGGCGTGCCCGACAGA TTCAGCGGCAGCGGCTCCGGCACCGACTTCAC CCTGAAGATCAGCCGGGTGGAAGCCGAGGACC TGGGCGTGTACTTCTGCAGCCAGTCCACCCAC GTGCCCCTGACCTTCGGAGCCGGCACCAAGCT GGAACTGAAGCGGGCTGATGCTGCACCGACTG TGTCCATCTTCCCACCATCCAGTGAGCAGTTAA CATCTGGAGGTGCCTCAGTCGTGTGCTTCTTGA ACAACTTCTACCCCAAAGACATCAATGTCAAG TGGAAGATTGATGGCAGTGAACGACAAAATGG CGTCCTGAACAGTTGGACTGATCAGGACAGCA AAGACAGCACCTACAGCATGAGCAGCACCCTC ACGTTGACCAAGGACGAGTATGAACGACATAA | 1250 |

TABLE 49-continued

HlgA/LukE Antibody Light Chain Primary Transcripts

| mAB/Fab name | Construct ID | Light Chain Primary Transcript | SEQ ID NO: |
|---|---|---|---|
| | | CAGCTATACCTGTGAGGCCACTCACAAGACAT CAACTTCACCCATTGTCAAGAGCTTCAACAGG AATGAGTGTTAG | |
| SM1B310 | pDR000029316 | ATGGAGACACATTCTCAGGTCTTTGTATACATG TTGCTGTGGTTGTCTGGTGTCGAGGGCGACATC GTGATGACCCAGAGCCACAAGTTCATGAGCAC CAGCGTGGGCGACCGGGTGTCCATCACATGCA AGGCCAGCCAGGATGTGTCTGCCGCCGTGGCC TGGTATCAGCAGAAGCCCGGCCAGAGCCCCAA GCTGCTGATCTACTGGGCCAGCACCAGACACA CCGGCGTGCCCGACAGATTCACAGGCAGCGGC AGCGGCACCGACTACACCCTGACCATCAGCAG CGTGCAGGCCGAGGACCTGGCCCTGTACTACT GCCAGCAGCACTACAGCACCCCCGGCACCTTC GGCGGAGGCACCAAGCTGGAAATCAAGCGGG CTGATGCTGCACCGACTGTGTCCATCTTCCCAC CATCCAGTGAGCAGTTAACATCTGGAGGTGCC TCAGTCGTGTGCTTCTTGAACAACTTCTACCCC AAAGACATCAATGTCAAGTGGAAGATTGATGG CAGTGAACGACAAAATGGCGTCCTGAACAGTT GGACTGATCAGGACAGCAAAGACAGCACCTAC AGCATGAGCAGCACCCTCACGTTGACCAAGGA CGAGTATGAACGACATAACAGCTATACCTGTG AGGCCACTCACAAGACATCAACTTCACCCATT GTCAAGAGCTTCAACAGGAATGAGTGTTAG | 1251 |
| SM1B311 | pDR000029315 | ATGGAGACACATTCTCAGGTCTTTGTATACATG TTGCTGTGGTTGTCTGGTGTCGAGGGCGACGTG CTGATGACCCAGACCCCCCTGAGCCTGCCCGT GTCTCTGGGCGATCAGGCCAGCATCAGCTGCC GGTCCAGCCAGACCATCGTGCACAGCAGCGGC AACACCTACCTGGAATGGTATCTGCAGCGGCC TGGCCAGAGCCCCAAGCTGCTGATCTACAAGG TGTCCAACCGGTTCAGCGGCGTGCCCGACAGA TTCAGCGGCAGCGGCTCCGGCACCGACTTCAC CCTGAAGATCAGCCGGGTGGAAGCCGAGGACC TGGGCGTGTACTACTGTTTTCAGGGCAGCCAC GTGCCCTACACCTTCGGCGGAGGCACCAAGCT GGAAATCAAGCGGGCTGATGCTGCACCGACTG TGTCCATCTTCCCACCATCCAGTGAGCAGTTAA CATCTGGAGGTGCCTCAGTCGTGTGCTTCTTGA ACAACTTCTACCCCAAAGACATCAATGTCAAG TGGAAGATTGATGGCAGTGAACGACAAAATGG CGTCCTGAACAGTTGGACTGATCAGGACAGCA AAGACAGCACCTACAGCATGAGCAGCACCCTC ACGTTGACCAAGGACGAGTATGAACGACATAA CAGCTATACCTGTGAGGCCACTCACAAGACAT CAACTTCACCCATTGTCAAGAGCTTCAACAGG AATGAGTGTTAG | 1252 |
| SM1B312 | pDR000029297 | ATGGAGACACATTCTCAGGTCTTTGTATACATG TTGCTGTGGTTGTCTGGTGTCGAGGGCGACATC CAGATGACCCAGACCACCAGCAGCCTGAGCGC CAGCCTGGGCGACAGAGTGACCATCAGCTGTA GCGCCTCCCAGGGCATCAGCAACTACCTGAAC TGGTATCAGCAGAAACCCGACGGCACCGTGAA GCTGCTGATCTACTACACCAGCTCCCTGCACAG CGGCGTGCCCAGCAGATTTTCTGGCAGCGGCA GCGGCACCGACTACAGCCTGACCATCTCCAAC CTGGAACCCGAGGATATCGCCACCTACTACTG CCAGCAGTACAGCAAGCTGCCCTTCACCTTCG GCTCCGGCACCAAGCTGGAAATCAAGCGGGCT GATGCTGCACCGACTGTGTCCATCTTCCCACCA TCCAGTGAGCAGTTAACATCTGGAGGTGCCTC AGTCGTGTGCTTCTTGAACAACTTCTACCCCAA AGACATCAATGTCAAGTGGAAGATTGATGGCA GTGAACGACAAAATGGCGTCCTGAACAGTTGG ACTGATCAGGACAGCAAAGACAGCACCTACAG CATGAGCAGCACCCTCACGTTGACCAAGGACG AGTATGAACGACATAACAGCTATACCTGTGAG GCCACTCACAAGACATCAACTTCACCCATTGTC AAGAGCTTCAACAGGAATGAGTGTTAG | 1253 |

TABLE 49-continued

HlgA/LukE Antibody Light Chain Primary Transcripts

| mAB/Fab name | Construct ID | Light Chain Primary Transcript | SEQ ID NO: |
|---|---|---|---|
| SM1B313 | pDR000029314 | ATGGAGACACATTCTCAGGTCTTTGTATACATG TTGCTGTGGTTGTCTGGTGTCGAGGGCGACATC GTGATGAGCCAGAGCCCCAGCAGCCTGGCCGT GTCCGTGGGCGAGAAAGTGACCATGAGCTGCA AGAGCAGCCAGAGCCTGCTGTACAGCTCCAAC CAGAAGAACTACCTGGCCTGGTATCAGCAGAA GCCCGGCCAGTCCCCCAAGCTGCTGATCTACT GGGCCAGCACCCGCGAGAGCGGCGTGCCAGAT AGACTGACAGGCAGCGGCAGCGGCACCGACTT CACCCTGACCATCAGCAGCGTGAAGGCCGAGG ATCTGGCCGTGTACTACTGCCAGCAGTACTAC AGCTACCCCTACACCTTCGGCGGAGGCACCAA GCTGGAAATCAAGCGGGCTGATGCTGCACCGA CTGTGTCCATCTTCCCACCATCCAGTGAGCAGT TAACATCTGGAGGTGCCTCAGTCGTGTGCTTCT TGAACAACTTCTACCCCAAAGACATCAATGTC AAGTGGAAGATTGATGGCAGTGAACGACAAA ATGGCGTCCTGAACAGTTGGACTGATCAGGAC AGCAAAGACAGCACCTACAGCAGCAC CCTCACGTTGACCAAGGACGAGTATGAACGAC ATAACAGCTATACCTGTGAGGCCACTCACAAG ACATCAACTTCACCCATTGTCAAGAGCTTCAAC AGGAATGAGTGTTAG | 1254 |
| SM1B314 | pDR000007289 | ATGGAGACACATTCTCAGGTCTTTGTATACATG TTGCTGTGGTTGTCTGGTGTCGAGGGCGACATT CAGATGACTCAGTCTCCAGCCTCCCTATCTGTA TCTGTGGGAGAAACTGTCACCATCACATGTCG AGCAAGTGAAAATATTTACAGTAATTTAGCAT GGTATCAGCAGAAACAGGGAAAATCTCCTCAG CTCCTGGTCTATGCTGCAACAAACTTAGCAGAT GGTGTGCCATCAAGGTTCAGTGGCAGTGGATC AGGCACACAGTATTCCCTCAAGATCAACAGCC TGCAGTCTGAAGATTTTGGGAGTTATTACTGTC AACATTTTTGGGGTACTCCGTACACGTTCGGAG GGGGGACCAAGCTGGAAATAAAACGGGCTGA TGCTGCACCGACTGTGTCCATCTTCCCACCATC CAGTGAGCAGTTAACATCTGGAGGTGCCTCAG TCGTGTGCTTCTTGAACAACTTCTACCCCAAAG ACATCAATGTCAAGTGGAAGATTGATGGCAGT GAACGACAAAATGGCGTCCTGAACAGTTGGAC TGATCAGGACAGCAAAGACAGCACCTACAGCA TGAGCAGCACCCTCACGTTGACCAAGGACGAG TATGAACGACATAACAGCTATACCTGTGAGGC CACTCACAAGACATCAACTTCACCCATTGTCA AGAGCTTCAACAGGAATGAGTGTTAG | 1255 |
| SM1B315 | pDR000026238 | ATGGAGACACATTCTCAGGTCTTTGTATACATG TTGCTGTGGTTGTCTGGTGTCGAGGGCGACATC AAGATGACCCAGAGCCCCAGCTCTATGTACGC CAGCCTGGGCGAGCGCGTGACCATCACATGCA AGGCCAGCCAGGACATCAACAGCTACCTGAGC TGGTTCCAGCAGAAGCCCGGCAAGAGCCCCAA GACCCTGATCTACCGGGCCAACAGACTGGTGG ACGGCGTGCCAAGCAGATTCAGCGGCAGCGGC TCTGGCCAGGACTACAGCCTGACCATCAGCAG CCTGGAATACGAGGACATGGGCATCTACTACT GCCTGCAGTACGACGAGTTCCCCTACACCTTCG GCGGAGGCACCAAGCTGGAAATCAAGCGGGCT GATGCTGCACCGACTGTGTCCATCTTCCCACCA TCCAGTGAGCAGTTAACATCTGGAGGTGCCTC AGTCGTGTGCTTCTTGAACAACTTCTACCCCAA AGACATCAATGTCAAGTGGAAGATTGATGGCA GTGAACGACAAAATGGCGTCCTGAACAGTTGG ACTGATCAGGACAGCAAAGACAGCACCTACAG CATGAGCAGCACCCTCACGTTGACCAAGGACG AGTATGAACGACATAACAGCTATACCTGTGAG GCCACTCACAAGACATCAACTTCACCCATTGTC AAGAGCTTCAACAGGAATGAGTGTTAG | 1256 |
| SM1B316 | pDR000029313 | ATGGAGACACATTCTCAGGTCTTTGTATACATG TTGCTGTGGTTGTCTGGTGTCGAGGGCGACATC CAGATGACCCAGACCACCAGCAGCCTGAGCGC CAGCCTGGGCGACAGAGTGACCATCAGCTGTA | 1257 |

TABLE 49-continued

HlgA/LukE Antibody Light Chain Primary Transcripts

| mAB/Fab name | Construct ID | Light Chain Primary Transcript | SEQ ID NO: |
|---|---|---|---|
| | | GCGCCTCCCAGGGCATCAGCAACTACCTGAAC TGGTATCAGCAGAAACCCGACGGCACCGTGAA GCTGCTGATCCACTACACCAGCTCCCTGCACA GCGGCGTGCCCAGCAGATTTTCTGGCAGCGGC AGCGGCACCGACTACAGCCTGACCATCTCCAA CCTGGAACCCGAGGATATCGCCACCTACTACT GCCAGCAGTACAGCAAGCTGCCCTGGACCTTC GGCGGAGGCACCAAGCTGGAAATCAAGCGGG CTGATGCTGCACCGACTGTGTCCATCTTCCCAC CATCCAGTGAGCAGTTAACATCTGGAGGTGCC TCAGTCGTGTGCTTCTTGAACAACTTCTACCCC AAAGACATCAATGTCAAGTGGAAGATTGATGG CAGTGAACGACAAAATGGCGTCCTGAACAGTT GGACTGATCAGGACAGCAAAGACAGCACCTAC AGCATGAGCAGCACCCTCACGTTGACCAAGGA CGAGTATGAACGACATAACAGCTATACCTGTG AGGCCACTCACAAGACATCAACTTCACCCATT GTCAAGAGCTTCAACAGGAATGAGTGTTAG | |
| SM1B317 | pDR000029312 | ATGGAGACACATTCTCAGGTCTTTGTATACATG TTGCTGTGGTTGTCTGGTGTCGAGGGCGACGTG CTGATGACCCAGACCCCCCTGAGCCTGCCCGT GTCTCTGGGCGATCAGGCCAGCATCAGCTGCC GGTCCAGCCAGACCATCGTGTACAGCGACGGC AACACCTACCTGGAATGGTATCTGCAGAAGCC CGGCCAGAGCCCCAAGCTGCTGATCTACAAGG TGTCCAACCGGTTCAGCGGCGTGCCCGACAGA GTGTCTGGCAGCGGCAGCGGCACCGACTTCAC CCTGAAGATCAGCCGGGTGGAAGCCGAGGACC TGGGCGTGTACTACTGTTTTCAGGGCAGCCAC GTGCCCTACACCTTCGGCGGAGGCACCAAGCT GGAAATCAAGCGGGCTGATGCTGCACCGACTG TGTCCATCTTCCCACCATCCAGTGAGCAGTTAA CATCTGGAGGTGCCTCAGTCGTGTGCTTCTTGA ACAACTTCTACCCCAAAGACATCAATGTCAAG TGGAAGATTGATGGCAGTGAACGACAAAATGG CGTCCTGAACAGTTGGACTGATCAGGACAGCA AAGACAGCACCTACAGCATGAGCAGCACCCTC ACGTTGACCAAGGACGAGTATGAACGACATAA CAGCTATACCTGTGAGGCCACTCACAAGACAT CAACTTCACCCATTGTCAAGAGCTTCAACAGG AATGAGTGTTAG | 1258 |
| SM1B318 | pDR000029312 | ATGGAGACACATTCTCAGGTCTTTGTATACATG TTGCTGTGGTTGTCTGGTGTCGAGGGCGACGTG CTGATGACCCAGACCCCCCTGAGCCTGCCCGT GTCTCTGGGCGATCAGGCCAGCATCAGCTGCC GGTCCAGCCAGACCATCGTGTACAGCGACGGC AACACCTACCTGGAATGGTATCTGCAGAAGCC CGGCCAGAGCCCCAAGCTGCTGATCTACAAGG TGTCCAACCGGTTCAGCGGCGTGCCCGACAGA GTGTCTGGCAGCGGCAGCGGCACCGACTTCAC CCTGAAGATCAGCCGGGTGGAAGCCGAGGACC TGGGCGTGTACTACTGTTTTCAGGGCAGCCAC GTGCCCTACACCTTCGGCGGAGGCACCAAGCT GGAAATCAAGCGGGCTGATGCTGCACCGACTG TGTCCATCTTCCCACCATCCAGTGAGCAGTTAA CATCTGGAGGTGCCTCAGTCGTGTGCTTCTTGA ACAACTTCTACCCCAAAGACATCAATGTCAAG TGGAAGATTGATGGCAGTGAACGACAAAATGG CGTCCTGAACAGTTGGACTGATCAGGACAGCA AAGACAGCACCTACAGCATGAGCAGCACCCTC ACGTTGACCAAGGACGAGTATGAACGACATAA CAGCTATACCTGTGAGGCCACTCACAAGACAT CAACTTCACCCATTGTCAAGAGCTTCAACAGG AATGAGTGTTAG | 1259 |
| SM1B319 | pDR000029311 | ATGGAGACACATTCTCAGGTCTTTGTATACATG TTGCTGTGGTTGTCTGGTGTCGAGGGCGACATC GTGATGACCCAGGCCGCTCCCAGCGTGCCAGT GACACCTGGCGAGAGCGTGTCCATCAGCTGCA GAAGCAGCAAGAGCCTGCTGCACAGCAACGGC AATACCTACCTGTACTGGTTCCTGCAGCGGCCT GGCCAGAGCCCCCAGCTGCTGATCTACCGGAT | 1260 |

TABLE 49-continued

HlgA/LukE Antibody Light Chain Primary Transcripts

| mAB/Fab name | Construct ID | Light Chain Primary Transcript | SEQ ID NO: |
|---|---|---|---|
| | | GAGCAACCTGGCCAGCGGCGTGCCCGACAGAT TTTCTGGCAGCGGCAGCGGCACCGCCTTCACC CTGCGGATCAGCAGAGTGGAAGCCGAGGACGT GGGCGTGTACTACTGCATGCAGCACCTGGAAT ACCCCTTCACCTTCGGCTCCGGCACCAAGCTGG AAATCAAGCGGGCTGATGCTGCACCGACTGTG TCCATCTTCCCACCATCCAGTGAGCAGTTAACA TCTGGAGGTGCCTCAGTCGTGTGCTTCTTGAAC AACTTCTACCCCAAAGACATCAATGTCAAGTG GAAGATTGATGGCAGTGAACGACAAAATGGCG TCCTGAACAGTTGGACTGATCAGGACAGCAAA GACAGCACCTACAGCATGAGCAGCACCCTCAC GTTGACCAAGGACGAGTATGAACGACATAACA GCTATACCTGTGAGGCCACTCACAAGACATCA ACTTCACCCATTGTCAAGAGCTTCAACAGGAA TGAGTGTTAG | |
| SM1B320 | pDR000007336 | ATGGAGACACATTCTCAGGTCTTTGTATACATG TTGCTGTGGTTGTCTGGTGTCGAGGGCGATATC CAGATGACACAGACTACATCCTCCCTGTCTGCC TCTCTGGGAGACAGAGTCACCATCAGTTGCAG TGCAAGTCAGGGCATTAGCAATTATTTAAACT GGTATCAGCAGAAACCAGATGGAACTGTTAAA CTCCTGATCTATTACACATCAAGTTTACACTCA GGAGTCCCATCAAGGTTCAGTGGCAGTGGGTC TGGGACAGATTATTCTCTCACCATCAGCAACCT GGAACCTGAAGATATTGCCACTTACTATTGTCA GCAGTATAGTAAGCTTCCGTACACGTTCGGAG GGGGGACCAAGCTGGAAATAAAACGGGCTGA TGCTGCACCGACTGTGTCCATCTTCCCACCATC CAGTGAGCAGTTAACATCTGGAGGTGCCTCAG TCGTGTGCTTCTTGAACAACTTCTACCCCAAAG ACATCAATGTCAAGTGGAAGATTGATGGCAGT GAACGACAAAATGGCGTCCTGAACAGTTGGAC TGATCAGGACAGCAAAGACAGCACCTACAGCA TGAGCAGCACCCTCACGTTGACCAAGGACGAG TATGAACGACATAACAGCTATACCTGTGAGGC CACTCACAAGACATCAACTTCACCCATTGTCA AGAGCTTCAACAGGAATGAGTGTTAG | 1261 |
| SM1B321 | pDR000027048 | ATGGAGACACATTCTCAGGTCTTTGTATACATG TTGCTGTGGTTGTCTGGTGTCGAGGGCGACATC CAGATGACCCAGAGCCCCGCCAGCCTGAGCGC CTCTGTGGGCGAGACAGTGACCATCATCTGCC GGGCCAGCGAGAACATCTACAGCTACCTGGCC TGGTATCAGCAGAAGCAGGGCAAGAGCCCCCA GCTGCTGGTGTACAACGCCAAGACCCTGGTGG AAGGCGTGCCCAGCAGATTCAGCGGCAGCGGC TCCGGCACCCAGTTCAGCCTGAAGATCAACAG CCTGCAGCCCGAGGACTTCGGCAGCTACTACT GCCAGCACCACTACGGCAGCCCCTACACCTTC GGCGGAGGCACCAAGCTGGAAATCAAGCGGG CTGATGCTGCACCGACTGTGTCCATCTTCCCAC CATCCAGTGAGCAGTTAACATCTGGAGGTGCC TCAGTCGTGTGCTTCTTGAACAACTTCTACCCC AAAGACATCAATGTCAAGTGGAAGATTGATGG CAGTGAACGACAAAATGGCGTCCTGAACAGTT GGACTGATCAGGACAGCAAAGACAGCACCTAC AGCATGAGCAGCACCCTCACGTTGACCAAGGA CGAGTATGAACGACATAACAGCTATACCTGTG AGGCCACTCACAAGACATCAACTTCACCCATT GTCAAGAGCTTCAACAGGAATGAGTGTTAG | 1262 |
| SM1B322 | pDR000007338 | ATGGAGACACATTCTCAGGTCTTTGTATACATG TTGCTGTGGTTGTCTGGTGTCGAGGGCGACATT GTGATGACCCAGTCTCACAAATTCATGTCCAC ATCAGTAGGAGACAGGGTCAGCATCACCTGCA AGGCCAGTCAGGATGTGAGTACTGCTGTAGCC TGGTATCAACAGAAACCAGGACAATCTCCTAA ACTACTGATTTACTCGGCATCCTACCGGTACAC TGGAGTCCCTGATCGCTTCACTGGCAGTGGATC TGGGACGGATTTCACTTTCACCATCAGCAGTGT GCAGGCTGAAGACCTGGCAGTTTATTACTGTC AGCAACATTATAGTACTCCGTGGACGTTCGGT | 1263 |

TABLE 49-continued

HlgA/LukE Antibody Light Chain Primary Transcripts

| mAB/Fab name | Construct ID | Light Chain Primary Transcript | SEQ ID NO: |
|---|---|---|---|
| | | GGAGGCACCAAGCTGGAAATCAAACGGGCTG<br>ATGCTGCACCGACTGTGTCCATCTTCCCACCAT<br>CCAGTGAGCAGTTAACATCTGGAGGTGCCTCA<br>GTCGTGTGCTTCTTGAACAACTTCTACCCCAAA<br>GACATCAATGTCAAGTGGAAGATTGATGGCAG<br>TGAACGACAAAATGGCGTCCTGAACAGTTGGA<br>CTGATCAGGACAGCAAAGACAGCACCTACAGC<br>ATGAGCAGCACCCTCACGTTGACCAAGGACGA<br>GTATGAACGACATAACAGCTATACCTGTGAGG<br>CCACTCACAAGACATCAACTTCACCCATTGTCA<br>AGAGCTTCAACAGGAATGAGTGTTAG | |
| SM1B323 | pDR000029310 | ATGGAGACACATTCTCAGGTCTTTGTATACATG<br>TTGCTGTGGTTGTCTGGTGTCGAGGGCGAGAC<br>AACCGTGACCCAGAGCCCCGCCAGCCTGAGCA<br>TGGCCATCGGCGAGAAAGTGACCATCCGGTGC<br>ATCACCAGCACCGACATCGACGACGACATGAA<br>CTGGTATCAGCAGAAGCCCGGCGAGCCCCCCA<br>AGCTGCTGATCAGCGAGGGCAACACCCTGCGG<br>CCTGGCGTGCCCAGCAGATTCAGCAGCAGCGG<br>CTACGGCACCGACTTCGTGTTCACCATCGAGA<br>ACATGCTGAGCGAGGACGTGGCCGACTACTAC<br>TGCCTGCAGAGCGACAACCTGCCCTACACCTT<br>CGGCGGAGGCACCAAGCTGGAAATCAAGCGG<br>GCTGATGCTGCACCGACTGTGTCCATCTTCCCA<br>CCATCCAGTGAGCAGTTAACATCTGGAGGTGC<br>CTCAGTCGTGTGCTTCTTGAACAACTTCTACCC<br>CAAAGACATCAATGTCAAGTGGAAGATTGATG<br>GCAGTGAACGACAAAATGGCGTCCTGAACAGT<br>TGGACTGATCAGGACAGCAAAGACAGCACCTA<br>CAGCATGAGCAGCACCCTCACGTTGACCAAGG<br>ACGAGTATGAACGACATAACAGCTATACCTGT<br>GAGGCCACTCACAAGACATCAACTTCACCCAT<br>TGTCAAGAGCTTCAACAGGAATGAGTGTTAG | 1264 |
| SM1B324 | pDR000029309 | ATGGAGACACATTCTCAGGTCTTTGTATACATG<br>TTGCTGTGGTTGTCTGGTGTCGAGGGCGACATC<br>GTGATGACCCAGAGCCCCAGCAGCCTGTCCGT<br>GTCTGCCGGCGAGAAAGTGACCATGAGCTGCA<br>AGAGCAGCCAGAGCCTGCTGAACAGCGGCAAC<br>CAGAAGAACTACCTGGCCTGGTATCAGCAGAA<br>GCCCGGCCAGCCCCCCAAGCTGCTGATCTACG<br>GCGCCAGCACCAGAGAAAGCGGCGTGCCCGAC<br>AGATTCACCGGCAGCGGCTCCGGCACCGACTT<br>CACCCTGACCATCAGCAGCGTGCAGGCCGAGG<br>ACCTGGCCGTGTACTACTGCCAGAACGACCAC<br>AGCTACCCCCCCACCTTCGGCGGAGGCACCAA<br>GCTGGAAATCAAGCGGGCTGATGCTGCACCGA<br>CTGTGTCCATCTTCCCACCATCCAGTGAGCAGT<br>TAACATCTGGAGGTGCCTCAGTCGTGTGCTTCT<br>TGAACAACTTCTACCCCAAAGACATCAATGTC<br>AAGTGGAAGATTGATGGCAGTGAACGACAAA<br>ATGGCGTCCTGAACAGTTGGACTGATCAGGAC<br>AGCAAAGACAGCACCTACAGCATGAGCAGCAC<br>CCTCACGTTGACCAAGGACGAGTATGAACGAC<br>ATAACAGCTATACCTGTGAGGCCACTCACAAG<br>ACATCAACTTCACCCATTGTCAAGAGCTTCAAC<br>AGGAATGAGTGTTAG | 1265 |
| SM1B325 | pDR000029308 | ATGGAGACACATTCTCAGGTCTTTGTATACATG<br>TTGCTGTGGTTGTCTGGTGTCGAGGGCGACATC<br>CAGATGACCCAGAGCCCCAGCAGCCTGAGCGC<br>CAGCCTGGGCGAGAGAGTGTCCCTGACCTGCC<br>GGGCCAGCCAGGACATCGGCAACAGCCTGAAC<br>TGGCTGCAGCAGAAGCCCGACGGCACCATCAA<br>GCGGCTGATCTACGCCACCAGCAACCTGGACA<br>GCGGCGTGCCCAAGCGGTTCAGCGGCAGCAGA<br>TCCGGCAGCGACTACAGCCTGACCATCAGCAG<br>CCTGGAAAGCGAGGACTTCGTGAACTACTACT<br>GCCTGCAGTTCGCCAGCAGCCCCTGACCTTCG<br>GCACCGGCACCAAGCTGGAAATCAAGCGGGCT<br>GATGCTGCACCGACTGTGTCCATCTTCCCACCA<br>TCCAGTGAGCAGTTAACATCTGGAGGTGCCTC<br>AGTCGTGTGCTTCTTGAACAACTTCTACCCCAA | 1266 |

TABLE 49-continued

HlgA/LukE Antibody Light Chain Primary Transcripts

| mAB/Fab name | Construct ID | Light Chain Primary Transcript | SEQ ID NO: |
|---|---|---|---|
| | | AGACATCAATGTCAAGTGGAAGATTGATGGCA GTGAACGACAAAATGGCGTCCTGAACAGTTGG ACTGATCAGGACAGCAAAGACAGCACCTACAG CATGAGCAGCACCCTCACGTTGACCAAGGACG AGTATGAACGACATAACAGCTATACCTGTGAG GCCACTCACAAGACATCAACTTCACCCATTGTC AAGAGCTTCAACAGGAATGAGTGTTAG | |
| SM1B326 | pDR000007289 | ATGGAGACACATTCTCAGGTCTTTGTATACATG TTGCTGTGGTTGTCTGGTGTCGAGGGCGACATT CAGATGACTCAGTCTCCAGCCTCCCTATCTGTA TCTGTGGGAGAAACTGTCACCATCACATGTCG AGCAAGTGAAAATATTTACAGTAATTTAGCAT GGTATCAGCAGAAACAGGGAAAATCTCCTCAG CTCCTGGTCTATGCTGCAACAAACTTAGCAGAT GGTGTGCCATCAAGGTTCAGTGGCAGTGGATC AGGCACACAGTATTCCCTCAAGATCAACAGCC TGCAGTCTGAAGATTTTGGGAGTTATTACTGTC AACATTTTTGGGGTACTCCGTACACGTTCGGAG GGGGGACCAAGCTGGAAATAAAACGGGCTGA TGCTGCACCGACTGTGTCCATCTTCCCACCATC CAGTGAGCAGTTAACATCTGGAGGTGCCTCAG TCGTGTGCTTCTTGAACAACTTCTACCCCAAAG ACATCAATGTCAAGTGGAAGATTGATGGCAGT GAACGACAAAATGGCGTCCTGAACAGTTGGAC TGATCAGGACAGCAAAGACAGCACCTACAGCA TGAGCAGCACCCTCACGTTGACCAAGGACGAG TATGAACGACATAACAGCTATACCTGTGAGGC CACTCACAAGACATCAACTTCACCCATTGTCA AGAGCTTCAACAGGAATGAGTGTTAG | 1267 |
| SM1B327 | pDR000029307 | ATGGAGACACATTCTCAGGTCTTTGTATACATG TTGCTGTGGTTGTCTGGTGTCGAGGGCCAGATC GTGCTGACCCAGAGCCCCGCCATCATGAGCGC CAGCCCTGGCGAGAAAGTGACCATGACCTGCA GCGCCAGCAGCAACGTGTCCTACATGCACTGG TTCCAGCAGAAGTCCGGCACCAGCCCCAAGCG GTGGATCTACGACACCAGCAAGCTGGCCAGCG GCGTGCCCGCCAGATTTTCTGGCAGCGGCAGC GGCACCAGCTACAGCCTGACCGTGTCCAGCAT GGAAGCCGAGGACGCCGCCACCTACTACTGCC AGCAGTGGTCCAGCAACCCCCGGACCTTCGGC GGAGGCACCAAGCTGGAAATCAAGCGGGCTG ATGCTGCACCGACTGTGTCCATCTTCCCACCAT CCAGTGAGCAGTTAACATCTGGAGGTGCCTCA GTCGTGTGCTTCTTGAACAACTTCTACCCCAAA GACATCAATGTCAAGTGGAAGATTGATGGCAG TGAACGACAAAATGGCGTCCTGAACAGTTGGA CTGATCAGGACAGCAAAGACAGCACCTACAGC ATGAGCAGCACCCTCACGTTGACCAAGGACGA GTATGAACGACATAACAGCTATACCTGTGAGG CCACTCACAAGACATCAACTTCACCCATTGTCA AGAGCTTCAACAGGAATGAGTGTTAG | 1268 |
| SM1B328 | pDR000027029 | ATGGAGACACATTCTCAGGTCTTTGTATACATG TTGCTGTGGTTGTCTGGTGTCGAGGGCGACATC CAGATGACCCAGAGCCCCAGCAGCCTGAGCGC CAGCCTGGGCGAGAGAGTGTCCCTGACCTGCC GGGCCAGCCAGGACATCGGCAGCTACCTGAAC TGGCTGCAGCAGGAACCCGACGGCACCATCAA GCGGCTGATCTACGCCACCAGCTCCCTGGACA GCGGCGTGCCCAAGCGGTTCAGCGGCAGCAGA TCTGGCGCCGACTACAGCCTGACCATCAGCAG CCTGGAAAGCGAGGACTTCGTGGACTACTACT GCCTGCAGTACGCCACCTCCCCCCTGGACCTTCG GCGGAGGCACCAAGCTGGAAATCAAGCGGGCT GATGCTGCACCGACTGTGTCCATCTTCCCACCA TCCAGTGAGCAGTTAACATCTGGAGGTGCCTC AGTCGTGTGCTTCTTGAACAACTTCTACCCCAA AGACATCAATGTCAAGTGGAAGATTGATGGCA GTGAACGACAAAATGGCGTCCTGAACAGTTGG ACTGATCAGGACAGCAAAGACAGCACCTACAG CATGAGCAGCACCCTCACGTTGACCAAGGACG AGTATGAACGACATAACAGCTATACCTGTGAG | 1269 |

TABLE 49-continued

HlgA/LukE Antibody Light Chain Primary Transcripts

| mAB/Fab name | Construct ID | Light Chain Primary Transcript | SEQ ID NO: |
|---|---|---|---|
| | | GCCACTCACAAGACATCAACTTCACCCATTGTC AAGAGCTTCAACAGGAATGAGTGTTAG | |
| SM1B329 | pDR000029306 | ATGGAGACACATTCTCAGGTCTTTGTATACATG TTGCTGTGGTTGTCTGGTGTCGAGGGCGACATC CAGATGACCCAGAGCAGCAGCTACCTGAGCGT GTCCCTGGGCGGCAGAGTGACCATCACATGCA AGGCCAGCGACCACATCAACAACTGGCTGGCC TGGTATCAGCAGAAGCCCGGCAACGCCCCCAG ACTGCTGATCAGCGGCGCCACCAGCCTGGAAA CCGGCGTGCCAAGCAGATTCAGCGGCAGCGGC TCCGGCAAGGACTACACCCTGAGCATCACCAG CCTGCAGACCGAGGACGTGGCCACCTACTACT GCCAGCAGTACTGGTCCACCCCCTACACCTTCG GCGGAGGCACCAAGCTGGAAATCAAGCGGGCT GATGCTGCACCGACTGTGTCCATCTTCCCACCA TCCAGTGAGCAGTTAACATCTGGAGGTGCCTC AGTCGTGTGCTTCTTGAACAACTTCTACCCCAA AGACATCAATGTCAAGTGGAAGATTGATGGCA GTGAACGACAAAATGGCGTCCTGAACAGTTGG ACTGATCAGGACAGCAAAGACAGCACCTACAG CATGAGCAGCACCCTCACGTTGACCAAGGACG AGTATGAACGACATAACAGCTATACCTGTGAG GCCACTCACAAGACATCAACTTCACCCATTGTC AAGAGCTTCAACAGGAATGAGTGTTAG | 1270 |
| SM1B330 | pDR000029305 | ATGGAGACACATTCTCAGGTCTTTGTATACATG TTGCTGTGGTTGTCTGGTGTCGAGGGCCAGATC GTGCTGACCCAGAGCCCTGCCCTGATGAGCGC CAGCCCTGGCGAGAAAGTGACCATGACCTGCA GCGCCAGCAGCAGCGTGTCCTACATGTACTGG TATCAGCAGAAGCCCAGAAGCAGCCCCAAGCT GAAGTACGCCAGCAACCTGGCCAGCGGCGTGC CCGCCAGATTTTCTGGCAGCGGCAGCGGCACC AGCTACAGCCTGACCATCAGCAGCATGGAAGC CGAGGACGCCGCCACCTACTACTGCCAGCAGT GGTCCAGCAACCCCCCCATCACCTTCGGAGCC GGCACCAAGCTGGAACTGAAGCGGGCTGATGC TGCACCGACTGTGTCCATCTTCCCACCATCCAG TGAGCAGTTAACATCTGGAGGTGCCTCAGTCG TGTGCTTCTTGAACAACTTCTACCCCAAAGACA TCAATGTCAAGTGGAAGATTGATGGCAGTGAA CGACAAAATGGCGTCCTGAACAGTTGGACTGA TCAGGACAGCAAAGACAGCACCTACAGCATGA GCAGCACCCTCACGTTGACCAAGGACGAGTAT GAACGACATAACAGCTATACCTGTGAGGCCAC TCACAAGACATCAACTTCACCCATTGTCAAGA GCTTCAACAGGAATGAGTGTTAG | 1271 |
| SM1B331 | pDR000027141 | ATGGAGACACATTCTCAGGTCTTTGTATACATG TTGCTGTGGTTGTCTGGTGTCGAGGGCGACATC GTGATGACCCAGAGCCCCGCCACCCTGAGCGT GACCCCTGGCGATAGAGTGTCCCTGAGCTGCC GGGCCAGCCAGAGCATCAGCGACTACCTGCAC TGGTATCAGCAGAAGTCCCACGAGAGCCCCAG ACTGCTGATTAAGTACGACAGCCAGTCCATCA GCGGCATCCCCAGCAGATTCAGCGGCAGCGGC TCCGGCTCCGACTTCACCCTGAGCATCAACAG CGTGGAACCCGAGGACGTGGGCGTGTACTACT GCCAGAACGGCCACCGGTTCCCTTTCACCTTCG GCGGAGGCACCAAGCTGGAAATCAAGCGGGCT GATGCTGCACCGACTGTGTCCATCTTCCCACCA TCCAGTGAGCAGTTAACATCTGGAGGTGCCTC AGTCGTGTGCTTCTTGAACAACTTCTACCCCAA AGACATCAATGTCAAGTGGAAGATTGATGGCA GTGAACGACAAAATGGCGTCCTGAACAGTTGG ACTGATCAGGACAGCAAAGACAGCACCTACAG CATGAGCAGCACCCTCACGTTGACCAAGGACG AGTATGAACGACATAACAGCTATACCTGTGAG GCCACTCACAAGACATCAACTTCACCCATTGTC AAGAGCTTCAACAGGAATGAGTGTTAG | 1272 |
| SM1B332 | pDR000029304 | ATGGAGACACATTCTCAGGTCTTTGTATACATG TTGCTGTGGTTGTCTGGTGTCGAGGGCCAGATC | 1273 |

TABLE 49-continued

HlgA/LukE Antibody Light Chain Primary Transcripts

| mAB/Fab name | Construct ID | Light Chain Primary Transcript | SEQ ID NO: |
|---|---|---|---|
| | | GTGCTGACCCAGAGCCCCGCCATCATGAGCGC CAGCCCTGGCGAGAAAGTGACCCTGACCTGCA GCGCCAGCAGCAGCGTGTCCAGCAGCTACCTG TTCTGGTATCAGCAGAAGCCCGGCAGCAGCCC CAAGCTGTGGATCTACAGCACCAGCAACCTGG CCAGCGGCGTGCCCGTGCGGTTTAGCGGCAGC GGCTTTGGCACCAGCTACAGCCTGACCATCAG CCGGATGGAAGCCGAGGACGCCGCCAGCTACT TCTGCCACCAGTGGTCCAGCTACCCCCCCACCT TCGGAGCCGGCACCAAGCTGGAACTGAAGCGG GCTGATGCTGCACCGACTGTGTCCATCTTCCCA CCATCCAGTGAGCAGTTAACATCTGGAGGTGC CTCAGTCGTGTGCTTCTTGAACAACTTCTACCC CAAAGACATCAATGTCAAGTGGAAGATTGATG GCAGTGAACGACAAAATGGCGTCCTGAACAGT TGGACTGATCAGGACAGCAAAGACAGCACCTA CAGCATGAGCAGCACCCTCACGTTGACCAAGG ACGAGTATGAACGACATAACAGCTATACCTGT GAGGCCACTCACAAGACATCAACTTCACCCAT TGTCAAGAGCTTCAACAGGAATGAGTGTTAG | |
| SM1B333 | pDR000029303 | ATGGAGACACATTCTCAGGTCTTTGTATACATG TTGCTGTGGTTGTCTGGTGTCGAGGGCGACATC GTGCTGACCCAGAGCCCTGCCAGCCTGGCCGT GTCTCTGGGCCAGAGAGCCACCATCAGCTGCC GGGCCAGCGAGAGCGTGGACAGCTACGGCAA CAGCTTCATGCACTGGTATCAGCAGAAGCCCG GCCAGCCCCCCAAGCTGCTGATCTACCTGGCC AGCAACCTGGAAAGCGGCGTGCCCGCCAGATT CAGCGGCAGCGGCAGCAGAACCGACTTCACCC TGACCATCGACCCCGTGGAAGCCGACGACGCC GCCACCTACTACTGCCAGCAGAACAACGAGGA CCCCTACACCTTCGGCGGAGGCACCAAGCTGG AAATCAAGCGGGCTGATGCTGCACCGACTGTG TCCATCTTCCCACCATCCAGTGAGCAGTTAACA TCTGGAGGTGCCTCAGTCGTGTGCTTCTTGAAC AACTTCTACCCCAAAGACATCAATGTCAAGTG GAAGATTGATGGCAGTGAACGACAAAATGGCG TCCTGAACAGTTGGACTGATCAGGACAGCAAA GACAGCACCTACAGCATGAGCAGCACCCTCAC GTTGACCAAGGACGAGTATGAACGACATAACA GCTATACCTGTGAGGCCACTCACAAGACATCA ACTTCACCCATTGTCAAGAGCTTCAACAGGAA TGAGTGTTAG | 1274 |
| SM1B334 | pDR000029302 | ATGGAGACACATTCTCAGGTCTTTGTATACATG TTGCTGTGGTTGTCTGGTGTCGAGGGCGACGTG CTGATGACCCAGACCCCCCTGAGCCTGCCCGT GTCTCTGGGCGATCAGGCCAGCATCAGCTGCC GGTCCAGCCAGAGCATCGTGTACAGCAACGGC AACACCTACCTGGACTGGTATCTGCAGAAGCC CGGCCAGCCCCCCAAGCTGCTGATCTACAAGG TGTCCAACCGGTTCAGCGGCGTGCCCGACAGA TTCAGCGGCAGCGGCTCCGGCACCGACTTCAT CCTGAAGATCAGCCGGGTGGAAGCCGAGGACC TGGGCGTGTACTACTGTTTTCAGGGCAGCCAC GTGCCCTGGACCTTCGGCGGAGGCACCAAGCT GGAAATCAAGCGGGCTGATGCTGCACCGACTG TGTCCATCTTCCCACCATCCAGTGAGCAGTTAA CATCTGGAGGTGCCTCAGTCGTGTGCTTCTTGA ACAACTTCTACCCCAAAGACATCAATGTCAAG TGGAAGATTGATGGCAGTGAACGACAAAATGG CGTCCTGAACAGTTGGACTGATCAGGACAGCA AAGACAGCACCTACAGCATGAGCAGCACCCTC ACGTTGACCAAGGACGAGTATGAACGACATAA CAGCTATACCTGTGAGGCCACTCACAAGACAT CAACTTCACCCATTGTCAAGAGCTTCAACAGG AATGAGTGTTAG | 1275 |
| SM1B335 | pDR000029301 | ATGGAGACACATTCTCAGGTCTTTGTATACATG TTGCTGTGGTTGTCTGGTGTCGAGGGCGACGTG GTGGTCACCCAGACCCCCCTGAGCCTGCCCGT GTCCTTCGGCGACCAGGTGTCCATCAGCTGCA GAAGCAGCCAGAGCCTGGCCAACAGCTACGGC | 1276 |

TABLE 49-continued

HlgA/LukE Antibody Light Chain Primary Transcripts

| mAB/Fab name | Construct ID | Light Chain Primary Transcript | SEQ ID NO: |
|---|---|---|---|
| | | AACACCTACCTGAGCTGGTATCTGCACAAGCC CGGCCAGAGCCCCCAGCTGCTGATCTACGGCA TCAGCAACCGGTTCAGCGGCGTGCCCGACAGA TTCAGCGGCAGCGGCTCCGGCACCGACTTCAC CCTGAAGATCAGCACCATCAAGCCCGAGGACC TGGGCATGTACTACTGTCTGCAGGGCACCCAC CAGCCCTACACCTTCGGCGGAGGCACCAAGCT GGAAATCAAGCGGGCTGATGCTGCACCGACTG TGTCCATCTTCCCACCATCCAGTGAGCAGTTAA CATCTGGAGGTGCCTCAGTCGTGTGCTTCTTGA ACAACTTCTACCCCAAAGACATCAATGTCAAG TGGAAGATTGATGGCAGTGAACGACAAAATGG CGTCCTGAACAGTTGGACTGATCAGGACAGCA AAGACAGCACCTACAGCATGAGCAGCACCCTC ACGTTGACCAAGGACGAGTATGAACGACATAA CAGCTATACCTGTGAGGCCACTCACAAGACAT CAACTTCACCCATTGTCAAGAGCTTCAACAGG AATGAGTGTTAG | |
| SM1B336 | pDR000029300 | ATGGAGACACATTCTCAGGTCTTTGTATACATG TTGCTGTGGTTGTCTGGTGTCGAGGGCGACATC GTGATGAGCCAGAGCCCCAGCAGCCTGGCCGT GTCCGTGGGCGAGAAAGTGACCATGAGCTGCA AGAGCAGCCAGAGCGTGCTGTACAACAGCAAC CAGCGGAACTACCTGGCCTGGTATCAGCAGAA GCCCGGCCAGTCCCCCAAGCTGCTGATCTACT GGGCCAGCACCCGCGAGAGCGGCGTGCCAGAT AGAAGCACAGGCAGCGGCAGCGGCACCGACTT CACCCTGACCATCAGCAGCGTGCAGGCCGAGG ATCTGGCCGTGTACTACTGCCACCAGTACCTGA GCAGCTACACCTTCGGCGGAGGCACCAAGCTG GAAATCAAGCGGGCTGATGCTGCACCGACTGT GTCCATCTTCCCACCATCCAGTGAGCAGTTAAC ATCTGGAGGTGCCTCAGTCGTGTGCTTCTTGAA CAACTTCTACCCCAAAGACATCAATGTCAAGT GGAAGATTGATGGCAGTGAACGACAAAATGGC GTCCTGAACAGTTGGACTGATCAGGACAGCAA AGACAGCACCTACAGCATGAGCAGCACCCTCA CGTTGACCAAGGACGAGTATGAACGACATAAC AGCTATACCTGTGAGGCCACTCACAAGACATC AACTTCACCCATTGTCAAGAGCTTCAACAGGA ATGAGTGTTAG | 1277 |
| SM1B337 | pDR000029299 | ATGGAGACACATTCTCAGGTCTTTGTATACATG TTGCTGTGGTTGTCTGGTGTCGAGGGCGACATC GTGATGACCCAGAGCCACAAGTTCATGAGCAC CAGCGTGGGCGACCGGGTGTCCATCACATGCA AGGCCAGCCAGGACGTGGGCACCGCCGTGGCC TGGTATCAGCAGAAGCCCGGCCAGAGCCCCAA GCTGCTGATCTACTGGGCCAGCACCAGACACA CCGGCGTGCCCGACAGATTCACAGGCAGCGGC AGCGGCACCGACTTCACCCTGACCATCAGCAA CGTGCAGAGCGAGGACCTGGCCGACTACTTCT GCCAGCAGTACAGCAGCTACCCCCTGACCTTC GGAGCCGGCACCAAGCTGGAACTGAAGCGGG CTGATGCTGCACCGACTGTGTCCATCTTCCCAC CATCCAGTGAGCAGTTAACATCTGGAGGTGCC TCAGTCGTGTGCTTCTTGAACAACTTCTACCCC AAAGACATCAATGTCAAGTGGAAGATTGATGG CAGTGAACGACAAAATGGCGTCCTGAACAGTT GGACTGATCAGGACAGCAAAGACAGCACCTAC AGCATGAGCAGCACCCTCACGTTGACCAAGGA CGAGTATGAACGACATAACAGCTATACCTGTG AGGCCACTCACAAGACATCAACTTCACCCATT GTCAAGAGCTTCAACAGGAATGAGTGTTAG | 1278 |
| SM1B338 | pDR000029319 | ATGGAGACACATTCTCAGGTCTTTGTATACATG TTGCTGTGGTTGTCTGGTGTCGAGGGCGACATC GTGCTGACCCAGAGCCCTGCCAGCCTGGCCGT GTCTCTGGGCCAGAGAGCCACCATCAGCTGCC GGGCCAGCGAGAGCGTGGACAGCTACGGCAA CAGCTTCATGCACTGGTATCAGCAGAAGCCCG GCCAGCCCCCCAAGCTGCTGATCTACCGGGCC AGCAACCTGGAAAGCGGCATCCCCGCCAGATT | 1279 |

TABLE 49-continued

H1gA/LukE Antibody Light Chain Primary Transcripts

| mAB/Fab name | Construct ID | Light Chain Primary Transcript | SEQ ID NO: |
|---|---|---|---|
| | | CAGCGGCAGCGGCAGCCGGACCGACTTCACCC TGACCATCAACCCCGTGGAAGCCGACGACGTG GCCACCTACTACTGCCAGCAGAGCAACGAGGA CCCCCCCTGGACCTTCGGCGGAGGCACCAAGC TGGAAATCAAGCGGGCTGATGCTGCACCGACT GTGTCCATCTTCCCACCATCCAGTGAGCAGTTA ACATCTGGAGGTGCCTCAGTCGTGTGCTTCTTG AACAACTTCTACCCCAAAGACATCAATGTCAA GTGGAAGATTGATGGCAGTGAACGACAAAATG GCGTCCTGAACAGTTGGACTGATCAGGACAGC AAAGACAGCACCTACAGCATGAGCAGCACCCT CACGTTGACCAAGGACGAGTATGAACGACATA ACAGCTATACCTGTGAGGCCACTCACAAGACA TCAACTTCACCCATTGTCAAGAGCTTCAACAG GAATGAGTGTTAG | |
| SM1B339 | pDR000029319 | ATGGAGACACATTCTCAGGTCTTTGTATACATG TTGCTGTGGTTGTCTGGTGTCGAGGGCGACATC GTGCTGACCCAGAGCCCTGCCAGCCTGGCCGT GTCTCTGGGCCAGAGAGCCACCATCAGCTGCC GGGCCAGCGAGAGCGTGGACAGCTACGGCAA CAGCTTCATGCACTGGTATCAGCAGAAGCCCG GCCAGCCCCCCAAGCTGCTGATCTACCGGGCC AGCAACCTGGAAAGCGGCATCCCCGCCAGATT CAGCGGCAGCGGCAGCCGGACCGACTTCACCC TGACCATCAACCCCGTGGAAGCCGACGACGTG GCCACCTACTACTGCCAGCAGAGCAACGAGGA CCCCCCCTGGACCTTCGGCGGAGGCACCAAGC TGGAAATCAAGCGGGCTGATGCTGCACCGACT GTGTCCATCTTCCCACCATCCAGTGAGCAGTTA ACATCTGGAGGTGCCTCAGTCGTGTGCTTCTTG AACAACTTCTACCCCAAAGACATCAATGTCAA GTGGAAGATTGATGGCAGTGAACGACAAAATG GCGTCCTGAACAGTTGGACTGATCAGGACAGC AAAGACAGCACCTACAGCATGAGCAGCACCCT CACGTTGACCAAGGACGAGTATGAACGACATA ACAGCTATACCTGTGAGGCCACTCACAAGACA TCAACTTCACCCATTGTCAAGAGCTTCAACAG GAATGAGTGTTAG | 1280 |
| SM1B340 | pDR000029298 | ATGGAGACACATTCTCAGGTCTTTGTATACATG TTGCTGTGGTTGTCTGGTGTCGAGGGCGACATC CAGATGACCCAGACCACCAGCAGCCTGAGCGC CAGCCTGGGCGACAGAGTGACCATCAGCTGCC GGGCCAGCCAGGACATCGACAACTACCTGAAC TGGTATCAGCAGAAACCCGACGGCACCGTGAA GCTGCTGATCAGCTACACCAGCCGGCTGCACA GCGGCGTGCCCAGCAGATTTTCTGGCAGCGGC AGCGGCACCGACTACAGCCTGACCATCTCCAA CCTGGAACAGGAAGATTTCGCTACCTACTTCTG TCAGCAGGGCTACACCCTGCCCTGGACCTTCG GCGGAGGCACCAAGCTGGAAATCAAGCGGGCT GATGCTGCACCGACTGTGTCCATCTTCCCACCA TCCAGTGAGCAGTTAACATCTGGAGGTGCCTC AGTCGTGTGCTTCTTGAACAACTTCTACCCCAA AGACATCAATGTCAAGTGGAAGATTGATGGCA GTGAACGACAAAATGGCGTCCTGAACAGTTGG ACTGATCAGGACAGCAAAGACAGCACCTACAG CATGAGCAGCACCCTCACGTTGACCAAGGACG AGTATGAACGACATAACAGCTATACCTGTGAG GCCACTCACAAGACATCAACTTCACCCATTGTC AAGAGCTTCAACAGGAATGAGTGTTAG | 1281 |

SEQUENCE LISTING (1315 sequences)

SEQ ID NO: 1 - protein, 7 aa, Artificial
  antibody sequence
GYTFSTF

SEQ ID NO: 2 - protein, 7 aa, Artificial
  antibody sequence
GYAFSSS

SEQ ID NO: 3 - protein, 7 aa, Artificial
  antibody sequence
GYTFTSY

SEQ ID NO: 4 - protein, 7 aa, Artificial
  antibody sequence
GYTFTNY

SEQ ID NO: 5 - protein, 7 aa, Artificial
  antibody sequence
GFNIKDY

SEQ ID NO: 6 - protein, 7 aa, Artificial
  antibody sequence
GDSITSD

SEQ ID NO: 7 - protein, 7 aa, Artificial
  antibody sequence
GYTFSTY

SEQ ID NO: 8 - protein, 7 aa, Artificial
  antibody sequence
GYSFTGY

SEQ ID NO: 9 - protein, 7 aa, Artificial
  antibody sequence
GFTFSDY

SEQ ID NO: 10 - protein, 7 aa, Artificial
  antibody sequence
GYSFTSY

SEQ ID NO: 11 - protein, 7 aa, Artificial
  antibody sequence
GFTFSSY

SEQ ID NO: 12 - protein, 7 aa, Artificial
  antibody sequence
GYTFTNY

SEQ ID NO: 13 - protein, 7 aa, Artificial
  antibody sequence
GYTFSDY

SEQ ID NO: 14 - protein, 7 aa, Artificial
  antibody sequence
GFNIKDT

SEQ ID NO: 15 - protein, 7 aa, Artificial
  antibody sequence
GYTFTRY

SEQ ID NO: 16 - protein, 7 aa, Artificial
  antibody sequence
GYTFTTY

SEQ ID NO: 17 - protein, 7 aa, Artificial
  antibody sequence
GFSLTSY

SEQ ID NO: 18 - protein, 7 aa, Artificial
  antibody sequence
GFSLTGY

SEQ ID NO: 19 - protein, 7 aa, Artificial
  antibody sequence
GYTFTDY

SEQ ID NO: 20 - protein, 7 aa, Artificial
  antibody sequence
GFNIKDS

SEQ ID NO: 21 - protein, 6 aa, Artificial
  antibody sequence
LPGSGS

SEQ ID NO: 22 - protein, 6 aa, Artificial
  antibody sequence
YPGDGD

SEQ ID NO: 23 - protein, 6 aa, Artificial
  antibody sequence
DPSDSY

SEQ ID NO: 24 - protein, 6 aa, Artificial
  antibody sequence
KSYTGE

SEQ ID NO: 25 - protein, 6 aa, Artificial
  antibody sequence
DPANGN

SEQ ID NO: 26 - protein, 5 aa, Artificial
  antibody sequence
SYSGS

SEQ ID NO: 27 - protein, 6 aa, Artificial
  antibody sequence
NPNTGY

SEQ ID NO: 28 - protein, 6 aa, Artificial
  antibody sequence
DPYNGA

SEQ ID NO: 29 - protein, 6 aa, Artificial
  antibody sequence
SDGGSY

SEQ ID NO: 30 - protein, 6 aa, Artificial
  antibody sequence
HPSDSE

SEQ ID NO: 31 - protein, 6 aa, Artificial
  antibody sequence
NSNGGS

SEQ ID NO: 32 - protein, 6 aa, Artificial
  antibody sequence
NTYTGE

SEQ ID NO: 33 - protein, 6 aa, Artificial
  antibody sequence
LPGSDK

SEQ ID NO: 34 - protein, 6 aa, Artificial
  antibody sequence
DPANDI

SEQ ID NO: 35 - protein, 6 aa, Artificial
  antibody sequence
NPANDN

SEQ ID NO: 36 - protein, 6 aa, Artificial
  antibody sequence
NPNNGH

SEQ ID NO: 37 - protein, 6 aa, Artificial
  antibody sequence
NPSNDG

SEQ ID NO: 38 - protein, 5 aa, Artificial
  antibody sequence
GWNDK

SEQ ID NO: 39 - protein, 5 aa, Artificial
  antibody sequence
GWDDK

SEQ ID NO: 40 - protein, 6 aa, Artificial
  antibody sequence
NPNNGG

SEQ ID NO: 41 - protein, 6 aa, Artificial
  antibody sequence
DPEDGE

SEQ ID NO: 42 - protein, 7 aa, Artificial
  antibody sequence
GGYDGMD

SEQ ID NO: 43 - protein, 11 aa, Artificial
  antibody sequence
RNYDGYHYGMD

SEQ ID NO: 44 - protein, 10 aa, Artificial
  antibody sequence
AAYDNSYYFD

SEQ ID NO: 45 - protein, 14 aa, Artificial
  antibody sequence
YGYDYDGEYYYAMD

SEQ ID NO: 46 - protein, 7 aa, Artificial
  antibody sequence
GSLFGLD

SEQ ID NO: 47 - protein, 9 aa, Artificial
  antibody sequence
GDYVPGYFD

SEQ ID NO: 48 - protein, 9 aa, Artificial
  antibody sequence
DYGSPYAMD

SEQ ID NO: 49 - protein, 12 aa, Artificial
  antibody sequence
GGSKAFPYYAMD

SEQ ID NO: 50 - protein, 9 aa, Artificial
  antibody sequence
GLYGDYWYA

SEQ ID NO: 51 - protein, 8 aa, Artificial
  antibody sequence
GPTYYGLD

SEQ ID NO: 52 - protein, 7 aa, Artificial
  antibody sequence
LYVDFFD

SEQ ID NO: 53 - protein, 8 aa, Artificial
  antibody sequence
PDYPYAMD

SEQ ID NO: 54 - protein, 12 aa, Artificial
  antibody sequence
SPSYGSRGAWFA

SEQ ID NO: 55 - protein, 6 aa, Artificial
  antibody sequence
AGDDYV

SEQ ID NO: 56 - protein, 4 aa, Artificial
  antibody sequence
DWAD

SEQ ID NO: 57 - protein, 9 aa, Artificial
  antibody sequence
LDGHLYAVD

SEQ ID NO: 58 - protein, 9 aa, Artificial
  antibody sequence
SYYGYGDFD

SEQ ID NO: 59 - protein, 10 aa, Artificial
  antibody sequence
DGDSSGSWFA

SEQ ID NO: 60 - protein, 8 aa, Artificial
  antibody sequence
DHGDGGFA

SEQ ID NO: 61 - protein, 11 aa, Artificial
  antibody sequence
ENSGYGGNYFA

SEQ ID NO: 62 - protein, 4 aa, Artificial
  antibody sequence
SFGV

SEQ ID NO: 63 - protein, 8 aa, Artificial
  antibody sequence
SSSVSSSY

SEQ ID NO: 64 - protein, 11 aa, Artificial
  antibody sequence
SESVDNSGISF

SEQ ID NO: 65 - protein, 7 aa, Artificial
  antibody sequence
SQSVSDD

SEQ ID NO: 66 - protein, 6 aa, Artificial
  antibody sequence
SSSVSY

SEQ ID NO: 67 - protein, 8 aa, Artificial
  antibody sequence
HSNLISNY

SEQ ID NO: 68 - protein, 6 aa, Artificial
  antibody sequence
SSHVSY

SEQ ID NO: 69 - protein, 7 aa, Artificial
  antibody sequence
SQDINSY

SEQ ID NO: 70 - protein, 7 aa, Artificial
  antibody sequence
SQNVGTN

SEQ ID NO: 71 - protein, 11 aa, Artificial
  antibody sequence
SESVDGYGNSF

SEQ ID NO: 72 - protein, 12 aa, Artificial
  antibody sequence
SQSIVHSNGKTY

SEQ ID NO: 73 - protein, 11 aa, Artificial
  antibody sequence
SKSVSISGYSY

SEQ ID NO: 74 - protein, 11 aa, Artificial
  antibody sequence
SQSVDYDGDSY

SEQ ID NO: 75 - protein, 7 aa, Artificial
  antibody sequence
SENIYSY

SEQ ID NO: 76 - protein, 12 aa, Artificial
  antibody sequence
SQSIVYSNGNTY

SEQ ID NO: 77 - protein, 12 aa, Artificial
  antibody sequence
SQSLLHSDGKTY

SEQ ID NO: 78 - protein, 12 aa, Artificial
  antibody sequence
SQSLLDSDGETY

SEQ ID NO: 79 - protein, 7 aa, Artificial
  antibody sequence
SQDINKY

SEQ ID NO: 80 - protein, 12 aa, Artificial
  antibody sequence
SQSIVHSNGNTY

SEQ ID NO: 81 - protein, 7 aa, Artificial
  antibody sequence
SENVGTY

SEQ ID NO: 82 - protein, 7 aa, Artificial
  antibody sequence
SENIYSN

SEQ ID NO: 83 - protein, 7 aa, Artificial
  antibody sequence
SQNINVW

SEQ ID NO: 84 - protein, 8 aa, Artificial
  antibody sequence
SSSISSNY

SEQ ID NO: 85 - protein, 13 aa, Artificial
  antibody sequence
SQSLLYSSNQKNY

SEQ ID NO: 86 - protein, 12 aa, Artificial
  antibody sequence
SQSLVHSNGNTY

SEQ ID NO: 87 - protein, 12 aa, Artificial
  antibody sequence
SQSLLYSNGKTY

SEQ ID NO: 88 - protein, 3 aa, Artificial
  antibody sequence
RTS

SEQ ID NO: 89 - protein, 3 aa, Artificial
  antibody sequence
AAS

SEQ ID NO: 90 - protein, 3 aa, Artificial
  antibody sequence
YAS

SEQ ID NO: 91 - protein, 3 aa, Artificial
  antibody sequence
STS

SEQ ID NO: 92 - protein, 3 aa, Artificial
  antibody sequence
DTS

SEQ ID NO: 93 - protein, 3 aa, Artificial
  antibody sequence
RAN

SEQ ID NO: 94 - protein, 3 aa, Artificial
  antibody sequence
SAS

SEQ ID NO: 95 - protein, 3 aa, Artificial
  antibody sequence
RAS

SEQ ID NO: 96 - protein, 3 aa, Artificial
  antibody sequence
KVS

SEQ ID NO: 97 - protein, 3 aa, Artificial
  antibody sequence
LAS

SEQ ID NO: 98 - protein, 3 aa, Artificial
  antibody sequence
NAK

SEQ ID NO: 99 - protein, 3 aa, Artificial
  antibody sequence
LVS

SEQ ID NO: 100 - protein, 3 aa, Artificial
  antibody sequence
MVS

SEQ ID NO: 101 - protein, 3 aa, Artificial
  antibody sequence
YTS

SEQ ID NO: 102 - protein, 3 aa, Artificial
  antibody sequence
GAS

SEQ ID NO: 103 - protein, 3 aa, Artificial
  antibody sequence
AAT

SEQ ID NO: 104 - protein, 3 aa, Artificial
  antibody sequence
KAS

SEQ ID NO: 105 - protein, 3 aa, Artificial
  antibody sequence
WAS

SEQ ID NO: 106 - protein, 6 aa, Artificial
  antibody sequence
WSGYPF

SEQ ID NO: 107 - protein, 6 aa, Artificial
  antibody sequence
SKEVPY

SEQ ID NO: 108 - protein, 6 aa, Artificial
  antibody sequence
DYSSPW

SEQ ID NO: 109 - protein, 6 aa, Artificial
  antibody sequence
RSSYPF

SEQ ID NO: 110 - protein, 6 aa, Artificial
  antibody sequence
GSSIPF

SEQ ID NO: 111 - protein, 6 aa, Artificial
  antibody sequence
YSGYPY

SEQ ID NO: 112 - protein, 6 aa, Artificial
  antibody sequence
YDEFPY

SEQ ID NO: 113 - protein, 6 aa, Artificial
  antibody sequence
YNSYPF

SEQ ID NO: 114 - protein, 6 aa, Artificial
  antibody sequence
SNGDPF

SEQ ID NO: 115 - protein, 6 aa, Artificial
  antibody sequence
GSHVPW

SEQ ID NO: 116 - protein, 6 aa, Artificial
  antibody sequence
SRELPF

SEQ ID NO: 117 - protein, 6 aa, Artificial
  antibody sequence
WISNPP

SEQ ID NO: 118 - protein, 6 aa, Artificial
  antibody sequence
SNEDPL

SEQ ID NO: 119 - protein, 6 aa, Artificial
  antibody sequence
HYGSPY

SEQ ID NO: 120 - protein, 6 aa, Artificial
  antibody sequence
GSHVPF

SEQ ID NO: 121 - protein, 6 aa, Artificial
  antibody sequence
GTHFPY

SEQ ID NO: 122 - protein, 6 aa, Artificial
  antibody sequence
GTHFPQ

SEQ ID NO: 123 - protein, 6 aa, Artificial
  antibody sequence
GTHSPY

SEQ ID NO: 124 - protein, 5 aa, Artificial
  antibody sequence
YDNLR

SEQ ID NO: 125 - protein, 6 aa, Artificial
  antibody sequence
WSSYPP

SEQ ID NO: 126 - protein, 6 aa, Artificial
  antibody sequence
SYSYPL

SEQ ID NO: 127 - protein, 6 aa, Artificial
  antibody sequence
YDEFPL

SEQ ID NO: 128 - protein, 5 aa, Artificial
  antibody sequence
YDNLW

SEQ ID NO: 129 - protein, 6 aa, Artificial
  antibody sequence
FWGTPW

SEQ ID NO: 130 - protein, 6 aa, Artificial
  antibody sequence
GQSYPL

SEQ ID NO: 131 - protein, 6 aa, Artificial
  antibody sequence
GSSIPR

SEQ ID NO: 132 - protein, 6 aa, Artificial
  antibody sequence
SNEDPY

SEQ ID NO: 133 - protein, 6 aa, Artificial
  antibody sequence
SYEDPF

SEQ ID NO: 134 - protein, 6 aa, Artificial
  antibody sequence
YYSYPY

SEQ ID NO: 135 - protein, 7 aa, Artificial
  antibody sequence
STHVPPY

SEQ ID NO: 136 - protein, 108 aa, Artificial
  antibody sequence
DIVLTQSPAIMAASLGQKVTMTCSASSSVSSSYLHWYQQKSGASPKPLIHRTSNLASGVPARFSGSGSGTSYSLTISSVEAEDDATYYCQQWSGYPFTFGAGTKLELK

SEQ ID NO: 137 - protein, 111 aa, Artificial
  antibody sequence
DIVMTQSPASLAVSLGQRATISCRASESVDNSGISFMNWFQQKPGQPPKLLIYAASNQGSGVPARFSGSGSGTDFSLNIHPMEEDDTAMYFCQQSKEVPYTFGGGTKLEIK

SEQ ID NO: 138 - protein, 111 aa, Artificial
  antibody sequence
DIVLTQSPASLAVSLGQRATISCRASESVDNSGISFMNWFQQKPGQPPKLLIYAASNQGSGVPARFSGSGSGTDFSLNIHPMEEDDTAMYFCQQSKEVPYTFGGGTKLEIK

SEQ ID NO: 139 - protein, 107 aa, Artificial
  antibody sequence
DVVMTQTPKFLLVSAGDRVTITCKASQSVSDDVTWYQQKSGQSPKLLIYYASNRYTGVPDRFTGSGYGTDFTFTISTVQAEDLAVYFCQQDYSSPWTFGGGTKLEIK

SEQ ID NO: 140 - protein, 111 aa, Artificial; identical to SEQ ID NO: 137
  antibody sequence

SEQ ID NO: 141 - protein, 106 aa, Artificial
  antibody sequence
DIVLTQSPAIMSASPGEKVTITCSASSSVSYMHWFQQKPGTSPKLWIYSTSNLASGVPARFSGSGSGTSYSLTISRMEAEDAATYYCQQRSSYPFTFGSGTKLEIK

SEQ ID NO: 142 - protein, 108 aa, Artificial
  antibody sequence
DIVMTQSPTTMAASPGERITITCSAHSNLISNYLHWYQQKPGFSPKLLIYRTSNLASGVPARFSGSGSGTSYSLTIGTMEAEDVATYFCQQGSSIPFTFGSGTKLEIK

SEQ ID NO: 143 - protein, 106 aa, Artificial
  antibody sequence
QIVLTQSPTIMSASPGEKVTMTCSASSHVSYIYWYQQKPGSSPRLWIYDTSNLVSGVPARFSGSRSGTSYSLTISSMEAEDAATYYCQQYSGYPYTFGGGTKLEIK

SEQ ID NO: 144 - protein, 107 aa, Artificial
  antibody sequence
DIKMTQSPSSMYASLGERVTITCKASQDINSYLSWFQQKPGKSPKTLIYRANRLVDGVPSRFSGSGSGQDYSPTISSLEYEDMGIYYCLQYDEFPYTFGGGTKLEIK

SEQ ID NO: 145 - protein, 107 aa, Artificial
  antibody sequence
DIVMTQSQKFMSTSVGDRVSVTCKASQNVGTNVAWYQQKPGQSPKTLIYSASYRYSGVPDSFTGSGSGTDFTLTISNVQSEDWAEYFCQQYNSYPFTFGSGTKLEIK

SEQ ID NO: 146 - protein, 111 aa, Artificial
  antibody sequence
DIVLTQSPASLAVSLGQRATMSCRASESVDGYGNSFLHWYQQKPGQPPKLLIYRASNLESGIPARFSGTGSRTDFTLTITPVEADDVATYYCQQSNGDPFTFGSGTKLEIK

SEQ ID NO: 147 - protein, 112 aa, Artificial
  antibody sequence
DVLMTQTPLSLPVSLGDQASISCRSSQSIVHSNGKTYLEWYLQKPGQSPKLLIYKVSNRFSGVPDRFSGSGSGTDFTLKISRVEAEDLGVYYCLQGSHVPWTFGGGTKLELK

SEQ ID NO: 148 - protein, 111 aa, Artificial
  antibody sequence
DIVLTQSPASLAVSLGQRATISCRASKSVSISGYSYMHWYQQKPGQPPKLLIDLASNLESGVPARFSGSGSGTDFTLNIHPVEEEDAATYYCQHSRELPFTFGSGTKLEIK

SEQ ID NO: 149 - protein, 111 aa, Artificial; identical to SEQ ID NO: 146
  antibody sequence

SEQ ID NO: 150 - protein, 106 aa, Artificial
  antibody sequence
QIVLTQSPAIMSASPGEKVTMTCSASSSVSYMHWYQQKSGTSPKRWIYDTSKLASGVPARFSGSGSGTSYSLTISSMEAEDAATYYCQQWISNPPTFGGGTKLEIK

SEQ ID NO: 151 - protein, 111 aa, Artificial
  antibody sequence
DIVLTQSPASLAVSLEQRATISCKASQSVDYDGDSYMNWYQQKPGQPPKLLIYAASNLESGIPARFSGSGSGTDFTLNIHPVEEEDAATYYCQQSNEDPLTFGAGTKLELK

SEQ ID NO: 152 - protein, 107 aa, Artificial
  antibody sequence
DIQMTQSPASLSASVGETVTTICRASENIYSYLAWYQQKQGKSPQLLVYNAKTLVEGVPSRFSGSGSGTQFSLKINSLQPEDFGSYYCQHHYGSPYTFGGGTKLELK

SEQ ID NO: 153 - protein, 112 aa, Artificial
  antibody sequence
DVLMTQTPLSLPVSLGDQASISCRSSQSIVYSNGNTYLEWYLQKPGQSPKLLIYKVSNRFSGVPDRFSGSGSGTDFTLKISRVEAEDLGVYYCFQGSHVPFTFGSGTKLEIK

SEQ ID NO: 154 - protein, 112 aa, Artificial
  antibody sequence
DVVMTQTPLTLSVTIGQAASISCKSSQSLLHSDGKTYLNWLLQRPGQSPKRLIYLVSKLDSGVPDRFTGSGSGTDFTLKISRVEAEDLGVYYCWQGTHFPYTFGGGTKLEIK

SEQ ID NO: 155 - protein, 112 aa, Artificial
  antibody sequence
DVVMTQTPLTLSVTVGQPASISCKSSQSLLHSDGKTYLNWLLQRPGQSPKRLIYLVSKLDSGVPDRFTGSGSGTDFTLKISRVEAEDLGVYYCWQGTHFPYTFGGGTKLEIK

SEQ ID NO: 156 - protein, 112 aa, Artificial
  antibody sequence
DVVMTQTPLTLSVTIGQPASISCKSSQSLLDSDGETYLNWLLQRPGQSPKRLIYMVSKLDSGVPDRFTGSGSGTDFTLKISRVEAEDLGVYYCWQGTHFPQTFGGGTKLELK

SEQ ID NO: 157 - protein, 112 aa, Artificial
  antibody sequence
DVVMTQTPLTLSVTNGQPASISCKSSQSLLDSDGETYLNWLLQRPGQSPKRLIYLVSKLDSGVPDRFIGSGSGTDFTLKISRVEAEDLGVYFCWQGTHSPYTFGGGTKLEIK

SEQ ID NO: 158 - protein, 106 aa, Artificial
  antibody sequence
DIQMTQSPSSLSASLGGKVTITCKASQDINKYIAWYQHKPGKGPRLLIHYTSTLQPGIPSRFSGSGSGRDYSFSISNLEPEDIATYYCLQYDNLRTFGGGTKVEIK

SEQ ID NO: 159 - protein, 112 aa, Artificial
  antibody sequence
DVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPFTFGSGTKLEIK

SEQ ID NO: 160 - protein, 106 aa, Artificial
  antibody sequence
QIVLTQSPAIMSASPGEKVTMTCSASSSVSYMYWYQQKPGSSPRLLIYDTSNLASGVPVRFSGSGSGTSYSLTISRMEAEDAATYYCQQWSSYPPTFGGGTKLEIK

SEQ ID NO: 161 - protein, 111 aa, Artificial; identical to SEQ ID NO: 146
  antibody sequence

SEQ ID NO: 162 - protein, 107 aa, Artificial
  antibody sequence
NIVMTQSPKSMSMSVGERVTLSCKASENVGTYVSWYQQKPEQSPKLLIYGASNRYTGVPERFTGSGSATDFTLTISSVQAEDLADYHCGQSYSYPLTFGAGTKLELK

SEQ ID NO: 163 - protein, 107 aa, Artificial
  antibody sequence
DIKMTQSPSSMYASLGERVTITCKASQDINSYLSWFQQKPGKSPKTLIYRANRLVDGVPSRFSGSGSGQDYSLTISSLEYEDMGIYYCLQYDEFPLTFGAGTKLELK

SEQ ID NO: 164 - protein, 106 aa, Artificial
  antibody sequence
DIQMTQSPSSLSASLGGKVTITCKASQDINKYIAWYQHKPGKGPRLLIHYTSTLQPGIPSRFSGSGSGRDYSFSISNLEPEDIATYYCLQYDNLWTFGGGTKVEIK

SEQ ID NO: 165 - protein, 107 aa, Artificial
  antibody sequence
DIQMTQSPASLSASVGETVTIICRASENIYSNLAWYQQKQGKSPQLLVYAATNLADGMPSRFSGSGSGTQYSLKINSLQSEDFGSYYCQHFWGTPWTFGGGTKLEIK

SEQ ID NO: 166 - protein, 107 aa, Artificial
  antibody sequence
DIQMTQSPASLSASVGETVTIICRASENIYSYLAWYQQKQGKSPQLLFYNAKTLVEGVPSRFSGSGSGTQFSLKINSLQPEDFGSYYCQHHYGSPYTFGGGTKLELK

SEQ ID NO: 167 - protein, 107 aa, Artificial
  antibody sequence
DIQMTQSPSTLSASLGDTITITCHASQNINVWLSWYQQKPGNIPKLLIYKASNLHTGVPSRFSGSGSGTGFTLTISSLQPEDIATYYCQQGQSYPLTFGAGTKVEIK

SEQ ID NO: 168 - protein, 107 aa, Artificial
  antibody sequence
DIQMTQSPSTLSASLGDTITITCHASQNINVWLSWYQQKPGNIPKLLIYKASNLHTGVPSRFSGSGSGTGFTLTISSLQPEDIATYYCQQGQSYPYTFGGGTKLEIK

SEQ ID NO: 169 - protein, 108 aa, Artificial
  antibody sequence
EIVLTQSPTTMAASPGEKITITCSASSSISSNYLHWYQQKPGFSPKLLIYRTSNLASGVPARFSGSGSGTSYSLTIGTMEAEDVATYYCQQGSSIPRTFGGGTKLEIK

SEQ ID NO: 170 - protein, 111 aa, Artificial
  antibody sequence
DIVLTQSPASLAVSLGQRATISCKASQSVDYDGDSYMNWYQQKPGQPPKLLIYAASNLESGIPARFSGSGSGTDFTLNIHPVEEEDAATYYCQQSNEDPYTFGGGTKLEIK

SEQ ID NO: 171 - protein, 111 aa, Artificial
  antibody sequence
DIVLTQSPASLAVSLGQRASISCKASQSVDYDGDSYMNWYQQKPGQPPKLLIYAASNLESGIPARFSGSGSGTDFTLNIHPVEEEDAATYYCQQSYEDPFTFGSGTKLEIK

SEQ ID NO: 172 - protein, 106 aa, Artificial; identical to SEQ ID NO: 160
  antibody sequence

SEQ ID NO: 173 - protein, 107 aa, Artificial
  antibody sequence
DIVMTQSQKFMSTSVGDRVSVTCKASQNVGTNVAWYQQKPGQSPKALIYSASYRYSGVPDRFTGSGSGTDFTLTISNVQSEDLAEYFCQQYNSYPFTFGSGTKLEIK

SEQ ID NO: 174 - protein, 113 aa, Artificial
  antibody sequence
DIVMSQSPSSLAVSVGEKVTMSCKSSQSLLYSSNQKNYLAWYQQKPGQSPKLLIYWASTRESGVPDRFTGSGSGTDFTLTISSVKAEDLAVYYCQQYYSYPYTFGGGTKLEIK

SEQ ID NO: 175 - protein, 113 aa, Artificial
  antibody sequence
DVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPPYTFGGGTKLELK

SEQ ID NO: 176 - protein, 112 aa, Artificial
  antibody sequence
DVVMTQTPLTLSVTIGQPASISCKSSQSLLYSNGKTYLNWLLQRPGQSPKRLIYLVSKLDSGVPDRFTGSGSGTDFTLKISRVEAEDLGVFYCVQGTHFPQTFGGGTKLELK

SEQ ID NO: 177 - protein, 117 aa, Artificial
  antibody sequence
EVQLQQSGAELMTPGASVKISCKATGYTFSTFWIEWIKQRPGHGLEWIGEILPGSGSTKYNEKFKGKATFTADTSSNTAYMQLSSLTSEDSAVYYCARGGYDGMDYWGQGTSVTVSS

SEQ ID NO: 178 - protein, 117 aa, Artificial
  antibody sequence
EVQLQQSGAELMTPGASVKISCKATGYTFSTFWIEWIKQRPGHGLEWIGEILPGSGSTKYNEKFKGKATFTADTSSNTAYMQLSSLSSEDSAVYYCARGGYDGMDYWGQGTSVTVSS

SEQ ID NO: 179 - protein, 117 aa, Artificial
  antibody sequence
EVQLQQSEAELMTPGASVKISCKATGYTFSTFWIEWIKQRPGHGLEWIGEILPGSGSTKYNEKFKGKATFTADTSSNTAYMQLSSLTSEDSAVYYCARGGYDGMDYWGQGTSVTVSS

SEQ ID NO: 180 - protein, 121 aa, Artificial
  antibody sequence
EVQLQQSGAELVKPGASVKISCKASGYAFSSSWMNWVKQRPGKGLEWIGRIYPGDGDTNYHGKFKGKATLTADKSSSTAYMQLSSLTSEDSAVYFCARRNYDGYHYGMDYWGQGTSVTVSS

SEQ ID NO: 181 - protein, 117 aa, Artificial; identical to SEQ ID NO: 177
  antibody sequence

SEQ ID NO: 182 - protein, 120 aa, Artificial
  antibody sequence
EVQLQQSGAELVKPGTSVKMSCKASGYTFTSYWMHWVKLRPGQGLEWIGVIDPSDSYTNYNQKFKGRATLTGDTSSSTAYMQLSSLTSEDSAVYYCTRAAYDNSYYFDYWGQGTTLTVSS

SEQ ID NO: 183 - protein, 124 aa, Artificial
  antibody sequence
EVQLQQSGAELVKPGASVKISCKASGYAFSSSWMNWLKQRPGKGLEWIGRIYPGDGDTNYNGKFKGKATLTADKSSSTAYMQLSSLTSEDSAVYFCARYGYDYDGEYYYAMDYWGQGTSVTVSS

SEQ ID NO: 184 - protein, 117 aa, Artificial
  antibody sequence
QVQLKESGPELKKPGETVRISCKASGYTFTNYGMNWVKQTPGKGLKWIDWLKSYTGEPTHTGDFKGRFDLSLETSANTAYLQINNLKNEDTATYFCARGSLFGLDYWGQGTSVTVSS

SEQ ID NO: 185 - protein, 119 aa, Artificial
  antibody sequence
EVQLQQSGAELVKSGASVKLSCTASGFNIKDYYMHWVKQRPEQGLEWIGRIDPANGNTKYDPKFQDKATITSDTSSNTAYLQLSSLTSEDTAVYYCAEGDYVPGYFDVWGAGTTVTVSS

SEQ ID NO: 186 - protein, 118 aa, Artificial
  antibody sequence
EVQLQESGPSLVKPSQTLSLTCSVTGDSITSDYWNWIRKFPGNKLEYMGYISYSGSTYYNPSLKSRISITRDTSKNQYYLQLNSVTTEDTATYYCAGDYGSPYAMDYWGQGTSVTVSS

SEQ ID NO: 187 - protein, 122 aa, Artificial
  antibody sequence
QVQLQQSGAELAKPGASVKMSCKSSGYTFSTYWMHWVKQRPGQGLEWIGYINPNTGYTEYNQKFKDTATLTADKSSSTAYMQLSSLTSEDSAVYYCARGGSKAFPYYAMDYWGQGTSVTVSS

SEQ ID NO: 188 - protein, 119 aa, Artificial
  antibody sequence
EIQLQQSGPELVKPGASVKMSCKASGYSFTGYNMHWVKQSHGKSLEWIGYIDPYNGATSHNQKFKGKATLTVEKSSSTAYMQLNSLTSEDSAVYYCARGLYGDYWYAYWGQGTLVTVSS

SEQ ID NO: 189 - protein, 118 aa, Artificial
  antibody sequence
EVQLVESGGGLVKPGGSLKLSCAASGFTFSDYYMYWVRQTPEKRLEWVATISDGGSYTFYPDSVKGRFTISRDNAKNNLYLQMSSLKSEDTAMYYCARGPTYYGLDYWGQGTTLTVSS

SEQ ID NO: 190 - protein, 117 aa, Artificial
  antibody sequence
QVQLQQPGAELVRPGASVRLSCKASGYSFTSYWMSWVKVRPGQGLEWIGMIHPSDSETRLNQKFKDKATLTVDKSSSTAYMQLSSPTSEDSAVYYCARLYVDFFDYWGQGTTLTVSS

SEQ ID NO: 191 - protein, 118 aa, Artificial
  antibody sequence
DVKLVESGGGLVKLGGSLKLSCAASGFTFSSYYMSWVRQTPEKRLELVAAINSNGGSTYYPDTVKGRFTISRDNAKNTLYLQMSSLKSEDTALYYCARPDYPYAMDYWGQGTSVTVSS

SEQ ID NO: 192 - protein, 122 aa, Artificial
  antibody sequence
QIQLVQSGPELKKPGETVKISCKASGYTFTNYGMNWVKQAPGKGLKWMGWINTYTGEPTYADDFKGRFAFSLETSASTAYLQINNLKNEDTATYFCARSPSYGSRGAWFAYWSQGTLVTVSA

SEQ ID NO: 193 - protein, 122 aa, Artificial
  antibody sequence
QIQLVQSGPELKKPGETVKISCKASGYTFTNYGMNWVKQAPGKGLKWMGWINTYTGEPTYADDFKGRFAFSLETSASTAYLQINNLKNEDTATYFCARSPSYGSRGAWFAYWGQGTLVTVSA

SEQ ID NO: 194 - protein, 116 aa, Artificial
  antibody sequence
QVQLQQSGAELMKPGASVKISCKASGYTFSDYWIEWIKQRPGHGLEWMGEILPGSDKTNYNEKFKGKATFTADSSSNTAYMQLNSLTSEDSAVFYCATAGDDYVKWGQGTLVTVSA

SEQ ID NO: 195 - protein, 114 aa, Artificial
  antibody sequence
EVQLQQSGAELVKPGASVKLSCTASGFNIKDTYMHWVRQRPEQGLEWIGRIDPANDITKYDPKFQGKATITADTSSNTAYLQLSSLTSEDTAVYYCGRDWADYWGQGTTLTVSS

SEQ ID NO: 196 - protein, 114 aa, Artificial
  antibody sequence
EVQLQQSGAELVKPGASVKLSCTASGFNIKDTYMHWVKQRSEQGLEWIGRINPANDNTKYDPKFQGKATITADTSSNTAYLQLSSLTSEDTAVYYCGRDWADYWGQGTTLTVSS

SEQ ID NO: 197 - protein, 119 aa, Artificial
  antibody sequence
QVQLQQPGAELVKPGASVKLSCKASGYTFTRYWMHWVKQRPGQGLEWIGEINPNNGHTNYNEKFESRATLTVDKSSSTAYMQFNSLTSEDSAVYYCGRLDGHLYAVDYWGQGTSVTVSS

SEQ ID NO: 198 - protein, 119 aa, Artificial
  antibody sequence
QVQLQQPGTELKMPGTSVKLSCKASGYTFTTYWMHWVKLRPGQGFEWIGEINPSNDGTNYNEKFKRKATLTVDKPSSTAYMQLSSLTSEDSTIYYCTISYYGYGDFDYWGQGTTLTVSS

SEQ ID NO: 199 - protein, 119 aa, Artificial
  antibody sequence
QVQLKESGPDLVQPSQTLSLTCTVSGFSLTSYGVHWVRQPPGKGLEWVGTMGWNDKKYYNSALKSRLSISRNTSKNQVFLKLSSLQTEDTAMYYCTRDGDSSGSWFAYWGQGTLVTVSS

SEQ ID NO: 200 - protein, 117 aa, Artificial
  antibody sequence
QVQLKESGPDLVQPSQTLSLTCTVSGFSLTGYAVHWVRQPPGKGVEWVGTMGWDDKKFYNSALKSRLSISRDPSKNQVFFKLSSLQTEDTAMYYCTRDHGDGGFAYWGQGTLVTVSS

SEQ ID NO: 201 - protein, 121 aa, Artificial
  antibody sequence
EVQLQQSGPELVKPGASVKIPCKASGYTFTDYNMDWVKQSHGKSLEWIGNINPNNGGTIYNQNFKDRATLTVDKSSSTAYMELRSLTSEDTAVYYCTRENSGYGGNYFAYWGQGTTLTVSS

SEQ ID NO: 202 - protein, 114 aa, Artificial
  antibody sequence
EVQLQQSGAELVRPGASVKLSCTTSGFNIKDSLIYWVKQRPEQGLEWIGWIDPEDGETKFAPRFQDKATITSDTSSNTAYLRLSSLTSEDTAIYYCTRSFGVCWGQGTLVTVSA

SEQ ID NO: 203 - protein, 114 aa, Artificial; identical to SEQ ID NO: 202
  antibody sequence

SEQ ID NO: 204 - protein, 114 aa, Artificial; identical to SEQ ID NO: 202
  antibody sequence

SEQ ID NO: 205 - protein, 114 aa, Artificial; identical to SEQ ID NO: 202
  antibody sequence

SEQ ID NO: 206 - protein, 114 aa, Artificial; identical to SEQ ID NO: 202
  antibody sequence

SEQ ID NO: 207 - protein, 114 aa, Artificial; identical to SEQ ID NO: 202
  antibody sequence

SEQ ID NO: 208 - protein, 114 aa, Artificial; identical to SEQ ID NO: 202
  antibody sequence

SEQ ID NO: 209 - protein, 114 aa, Artificial; identical to SEQ ID NO: 202
  antibody sequence

SEQ ID NO: 210 - protein, 114 aa, Artificial; identical to SEQ ID NO: 202
  antibody sequence

SEQ ID NO: 211 - protein, 114 aa, Artificial; identical to SEQ ID NO: 202
  antibody sequence

SEQ ID NO: 212 - protein, 114 aa, Artificial; identical to SEQ ID NO: 202
  antibody sequence

SEQ ID NO: 213 - protein, 114 aa, Artificial; identical to SEQ ID NO: 202
  antibody sequence

SEQ ID NO: 214 - protein, 114 aa, Artificial; identical to SEQ ID NO: 202
  antibody sequence

SEQ ID NO: 215 - protein, 114 aa, Artificial; identical to SEQ ID NO: 202
  antibody sequence

SEQ ID NO: 216 - protein, 114 aa, Artificial; identical to SEQ ID NO: 202
  antibody sequence

SEQ ID NO: 217 - protein, 114 aa, Artificial; identical to SEQ ID NO: 202
  antibody sequence

SEQ ID NO: 218 - protein, 215 aa, Artificial
  antibody sequence
DIVLTQSPAIMAASLGQKVTMTCSASSSVSSSYLHWYQQKSGASPKPLIHRTSNLASGVPARFSGSGSGTSYSLTISSVEAEDDATYYCQQWSGYPFTFGAGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 219 - protein, 218 aa, Artificial
  antibody sequence
DIVMTQSPASLAVSLGQRATISCRASESVDNSGISFMNWFQQKPGQPPKLLIYAASNQGSGVPARFSGSGSGTDFSLNIHPMEEDDTAMYFCQQSKEVPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 220 - protein, 218 aa, Artificial
  antibody sequence
DIVLTQSPASLAVSLGQRATISCRASESVDNSGISFMNWFQQKPGQPPKLLIYAASNQGSGVPARFSGSGSGTDFSLNIHPMEEDDTAMYFCQQSKEVPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 221 - protein, 214 aa, Artificial
  antibody sequence
DVVMTQTPKFLLVSAGDRVTITCKASQSVSDDVTWYQQKSGQSPKLLIYYASNRYTGVPDRFTGSGYGTDFTFTISTVQAEDLAVYFCQQDYSSPWTFGGGTKLEIKRADAAPTVSIFSPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 222 - protein, 218 aa, Artificial; identical to SEQ ID NO: 219
  antibody sequence

SEQ ID NO: 223 - protein, 213 aa, Artificial
  antibody sequence
DIVLTQSPAIMSASPGEKVTITCSASSSVSYMHWFQQKPGTSPKLWIYSTSNLASGVPARFSGSGSGTSYSLTISRMEAEDAATYYCQQRSSYPFTFGSGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 224 - protein, 215 aa, Artificial
  antibody sequence
DIVMTQSPTTMAASPGERITITCSAHSNLISNYLHWYQQKPGFSPKLLIYRTSNLASGVPARFSGSGSGTSYSLTIGTMEAEDVATYFCQQGSSIPFTFGSGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 225 - protein, 213 aa, Artificial
  antibody sequence
QIVLTQSPTIMSASPGEKVTMTCSASSHVSYIYWYQQKPGSSPRLWIYDTSNLVSGVPARFSGSRSGTSYSLTISSMEAEDAATYYCQQYSGYPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 226 - protein, 214 aa, Artificial
  antibody sequence
DIKMTQSPSSMYASLGERVTITCKASQDINSYLSWFQQKPGKSPKTLIYRANRLVDGVPSRFSGSGSGQDYSPTISSLEYEDMGIYYCLQYDEFPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 227 - protein, 214 aa, Artificial
  antibody sequence
DIVMTQSQKFMSTSVGDRVSVTCKASQNVGTNVAWYQQKPGQSPKTLIYSASYRYSGVPDSFTGSGSGTDFTLTISNVQSEDWAEYFCQQYNSYPFTFGSGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 228 - protein, 218 aa, Artificial
  antibody sequence
DIVLTQSPASLAVSLGQRATMSCRASESVDGYGNSFLHWYQQKPGQPPKLLIYRASNLESGIPARFSGTGSRTDFTLTITPVEADDVATYYCQQSNGDPFTFGSGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 229 - protein, 219 aa, Artificial
  antibody sequence
DVLMTQTPLSLPVSLGDQASISCRSSQSIVHSNGKTYLEWYLQKPGQSPKLLIYKVSNRFSGVPDRFSGSGSGTDFTLKISRVEAEDLGVYYCLQGSHVPWTFGGGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 230 - protein, 218 aa, Artificial
  antibody sequence
DIVLTQSPASLAVSLGQRATISCRASKSVSISGYSYMHWYQQKPGQPPKLLIDLASNLESGVPARFSGSGSGTDFTLNIHPVEEEDAATYYCQHSRELPFTFGSGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 231 - protein, 218 aa, Artificial; identical to SEQ ID NO: 228
  antibody sequence

SEQ ID NO: 232 - protein, 213 aa, Artificial
  antibody sequence
QIVLTQSPAIMSASPGEKVTMTCSASSSVSYMHWYQQKSGTSPKRWIYDTSKLASGVPARFSGSGSGTSYSLTISSMEAEDAATYYCQQWISNPPTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 233 - protein, 218 aa, Artificial
  antibody sequence
DIVLTQSPASLAVSLEQRATISCKASQSVDYDGDSYMNWYQQKPGQPPKLLIYAASNLESGIPARFSGSGSGTDFTLNIHPVEEEDAATYYCQQSNEDPLTFGAGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 234 - protein, 214 aa, Artificial
  antibody sequence
DIQMTQSPASLSASVGETVTTICRASENIYSYLAWYQQKQGKSPQLLVYNAKTLVEGVPSRFSGSGSGTQFSLKINSLQPEDFGSYYCQHHYGSPYTFGGGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 235 - protein, 219 aa, Artificial
  antibody sequence
DVLMTQTPLSLPVSLGDQASISCRSSQSIVYSNGNTYLEWYLQKPGQSPKLLIYKVSNRFSGVPDRFSGSGSGTDFTLKISRVEAEDLGVYYCFQGSHVPFTFGSGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 236 - protein, 219 aa, Artificial
  antibody sequence
DVVMTQTPLTLSVTIGQAASISCKSSQSLLHSDGKTYLNWLLQRPGQSPKRLIYLVSKLDSGVPDRFTGSGSGTDFTLKISRVEAEDLGVYYCWQGTHFPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 237 - protein, 219 aa, Artificial
  antibody sequence
DVVMTQTPLTLSVTVGQPASISCKSSQSLLHSDGKTYLNWLLQRPGQSPKRLIYLVSKLDSGVPDRFTGSGSGTDFTLKISRVEAEDLGVYYCWQGTHFPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 238 - protein, 219 aa, Artificial
  antibody sequence
DVVMTQTPLTLSVTIGQPASISCKSSQSLLDSDGETYLNWLLQRPGQSPKRLIYMVSKLDSGVPDRFTGSGSGTDFTLKISRVEAEDLGVYYCWQGTHFPQTFGGGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 239 - protein, 219 aa, Artificial
  antibody sequence
DVVMTQTPLTLSVTNGQPASISCKSSQSLLDSDGETYLNWLLQRPGQSPKRLIYLVSKLDSGVPDRFIGSGSGTDFTLKISRVEAEDLGVYFCWQGTHSPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 240 - protein, 213 aa, Artificial
  antibody sequence
DIQMTQSPSSLSASLGGKVTITCKASQDINKYIAWYQHKPGKGPRLLIHYTSTLQPGIPSRFSGSGSGRDYSFSISNLEPEDIATYYCLQYDNLRTFGGGTKVEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 241 - protein, 219 aa, Artificial
  antibody sequence
DVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPFTFGSGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 242 - protein, 213 aa, Artificial
  antibody sequence
QIVLTQSPAIMSASPGEKVTMTCSASSSVSYMYWYQQKPGSSPRLLIYDTSNLASGVPVRFSGSGSGTSYSLTISRMEAEDAATYYCQQWSSYPPTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 243 - protein, 218 aa, Artificial; identical to SEQ ID NO: 228
  antibody sequence

SEQ ID NO: 244 - protein, 214 aa, Artificial
  antibody sequence
NIVMTQSPKSMSMSVGERVTLSCKASENVGTYVSWYQQKPEQSPKLLIYGASNRYTGVPERFTGSGSATDFTLTISSVQAEDLADYHCGQSYSYPLTFGAGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 245 - protein, 214 aa, Artificial
  antibody sequence
DIKMTQSPSSMYASLGERVTITCKASQDINSYLSWFQQKPGKSPKTLIYRANRLVDGVPSRFSGSGSGQDYSLTISSLEYEDMGIYYCLQYDEFPLTFGAGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 246 - protein, 213 aa, Artificial
  antibody sequence
DIQMTQSPSSLSASLGGKVTITCKASQDINKYIAWYQHKPGKGPRLLIHYTSTLQPGIPSRFSGSGSGRDYSFSISNLEPEDIATYYCLQYDNLWTFGGGTKVEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 247 - protein, 214 aa, Artificial
  antibody sequence
DIQMTQSPASLSASVGETVTIICRASENIYSNLAWYQQKQGKSPQLLVYAATNLADGMPSRFSGSGSGTQYSLKINSLQSEDFGSYYCQHFWGTPWTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 248 - protein, 214 aa, Artificial
  antibody sequence
DIQMTQSPASLSASVGETVTIICRASENIYSYLAWYQQKQGKSPQLLFYNAKTLVEGVPSRFSGSGSGTQFSLKINSLQPEDFGSYYCQHHYGSPYTFGGGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 249 - protein, 214 aa, Artificial
  antibody sequence
DIQMTQSPSTLSASLGDTITITCHASQNINVWLSWYQQKPGNIPKLLIYKASNLHTGVPSRFSGSGSGTGFTLTISSLQPEDIATYYCQQGQSYPLTFGAGTKVEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 250 - protein, 214 aa, Artificial
  antibody sequence
DIQMTQSPSTLSASLGDTITITCHASQNINVWLSWYQQKPGNIPKLLIYKASNLHTGVPSRFSGSGSGTGFTLTISSLQPEDIATYYCQQGQSYPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 251 - protein, 215 aa, Artificial
  antibody sequence
EIVLTQSPTTMAASPGEKITITCSASSSISSNYLHWYQQKPGFSPKLLIYRTSNLASGVPARFSGSGSGTSYSLTIGTMEAEDVATYYCQQGSSIPRTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 252 - protein, 218 aa, Artificial
  antibody sequence
DIVLTQSPASLAVSLGQRATISCKASQSVDYDGDSYMNWYQQKPGQPPKLLIYAASNLESGIPARFSGSGSGTDFTLNIHPVEEEDAATYYCQQSNEDPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 253 - protein, 218 aa, Artificial
  antibody sequence
DIVLTQSPASLAVSLGQRASISCKASQSVDYDGDSYMNWYQQKPGQPPKLLIYAASNLESGIPARFSGSGSGTDFTLNIHPVEEEDAATYYCQQSYEDPFTFGSGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 254 - protein, 213 aa, Artificial; identical to SEQ ID NO: 242
  antibody sequence

SEQ ID NO: 255 - protein, 214 aa, Artificial
  antibody sequence
DIVMTQSQKFMSTSVGDRVSVTCKASQNVGTNVAWYQQKPGQSPKALIYSASYRYSGVPDRFTGSGSGTDFTLTISNVQSEDLAEYFCQQYNSYPFTFGSGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 256 - protein, 220 aa, Artificial
  antibody sequence
DIVMSQSPSSLAVSVGEKVTMSCKSSQSLLYSSNQKNYLAWYQQKPGQSPKLLIYWASTRESGVPDRFTGSGSGTDFTLTISSVKAEDLAVYYCQQYYSYPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 257 - protein, 220 aa, Artificial
  antibody sequence
DVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPPYTFGGGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 258 - protein, 219 aa, Artificial
  antibody sequence
DVVMTQTPLTLSVTIGQPASISCKSSQSLLYSNGKTYLNWLLQRPGQSPKRLIYLVSKLDSGVPDRFTGSGSGTDFTLKISRVEAEDLGVFYCVQGTHFPQTFGGGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 259 - protein, 441 aa, Artificial
  antibody sequence
EVQLQQSGAELMTPGASVKISCKATGYTFSTFWIEWIKQRPGHGLEWIGEILPGSGSTKYNEKFKGKATFTADTSSNTAYMQLSSLTSEDSAVYYCARGGYDGMDYWGQGTSVTVSSAKTTPPSVYPLAPGSAAQTNSMVTLGCLVKGYFPEPVTVTWNSGSLSSGVHTFPAVLESDLYTLSSSVTVPSSPRPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMNTNGSYFVYSKLNVQKSNWEAGNTFTCSVLHEGLHNHHTEKSLSHSPGK

SEQ ID NO: 260 - protein, 441 aa, Artificial
  antibody sequence
EVQLQQSGAELMTPGASVKISCKATGYTFSTFWIEWIKQRPGHGLEWIGEILPGSGSTKYNEKFKGKATFTADTSSNTAYMQLSSLSSEDSAVYYCARGGYDGMDYWGQGTSVTVSSAKTTPPSVYPLAPGSAAQTNSMVTLGCLVKGYFPEPVTVTWNSGSLSSGVHTFPAVLESDLYTLSSSVTVPSSPRPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMNTNGSYFVYSKLNVQKSNWEAGNTFTCSVLHEGLHNHHTEKSLSHSPGK

SEQ ID NO: 261 - protein, 441 aa, Artificial
  antibody sequence
EVQLQQSEAELMTPGASVKISCKATGYTFSTFWIEWIKQRPGHGLEWIGEILPGSGSTKYNEKFKGKATFTADTSSNTAYMQLSSLTSEDSAVYYCARGGYDGMDYWGQGTSVTVSSAKTTPPSVYPLAPGSAAQTNSMVTLGCLVKGYFPEPVTVTWNSGSLSSGVHTFPAVLESDLYTLSSSVTVPSSPRPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMNTNGSYFVYSKLNVQKSNWEAGNTFTCSVLHEGLHNHHTEKSLSHSPGK

SEQ ID NO: 262 - protein, 445 aa, Artificial
  antibody sequence
EVQLQQSGAELVKPGASVKISCKASGYAFSSSWMNWVKQRPGKGLEWIGRIYPGDGDTNYHGKFKGKATLTADKSSSTAYMQLSSLTSEDSAVYFCARRNYDGYHYGMDYWGQGTSVTVSSAKTTPPSVYPLAPGSAAQTNSMVTLGCLVKGYFPEPVTVTWNSGSLSSGVHTFPAVLESDLYTLSSSVTVPSSPRPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMNTNGSYFVYSKLNVQKSNWEAGNTFTCSVLHEGLHNHHTEKSLSHSPGK

SEQ ID NO: 263 - protein, 441 aa, Artificial; identical to SEQ ID NO: 259
  antibody sequence

SEQ ID NO: 264 - protein, 444 aa, Artificial
  antibody sequence
EVQLQQSGAELVKPGTSVKMSCKASGYTFTSYWMHWVKLRPGQGLEWIGVIDPSDSYTNYNQKFKGRATLTGDTSSSTAYMQLSSLTSEDSAVYYCTRAAYDNSYYFDYWGQGTTLTVSSAKTTPPSVYPLAPGSAAQTNSMVTLGCLVKGYFPEPVTVTWNSGSLSSGVHTFPAVLESDLYTLSSSVTVPSSPRPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMNTNGSYFVYSKLNVQKSNWEAGNTFTCSVLHEGLHNHHTEKSLSHSPGK

SEQ ID NO: 265 - protein, 448 aa, Artificial
  antibody sequence
EVQLQQSGAELVKPGASVKISCKASGYAFSSSWMNWLKQRPGKGLEWIGRIYPGDGDTNYNGKFKGKATLTADKSSSTAYMQLSSLTSEDSAVYFCARYGYDYDGEYYYAMDYWGQGTSVTVSSAKTTPPSVYPLAPGSAAQTNSMVTLGCLVKGYFPEPVTVTWNSGSLSSGVHTFPAVLESDLYTLSSSVTVPSSPRPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMNTNGSYFVYSKLNVQKSNWEAGNTFTCSVLHEGLHNHHTEKSLSHSPGK

SEQ ID NO: 266 - protein, 441 aa, Artificial
  antibody sequence
QVQLKESGPELKKPGETVRISCKASGYTFTNYGMNWVKQTPGKGLKWIDWLKSYTGEPTHTGDFKGRFDLSLETSANTAYLQINNLKNEDTATYFCARGSLFGLDYWGQGTSVTVSSAKTTPPSVYPLAPGSAAQTNSMVTLGCLVKGYFPEPVTVTWNSGSLSSGVHTFPAVLESDLYTLSSSVTVPSSPRPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMNTNGSYFVYSKLNVQKSNWEAGNTFTCSVLHEGLHNHHTEKSLSHSPGK

SEQ ID NO: 267 - protein, 449 aa, Artificial
  antibody sequence
EVQLQQSGAELVKSGASVKLSCTASGFNIKDYYMHWVKQRPEQGLEWIGRIDPANGNTKYDPKFQDKATITSDTSSNTAYLQLSSLTSEDTAVYYCAEGDYVPGYFDVWGAGTTVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 268 - protein, 448 aa, Artificial
  antibody sequence
EVQLQESGPSLVKPSQTLSLTCSVTGDSITSDYWNWIRKFPGNKLEYMGYISYSGSTYYNPSLKSRISITRDTSKNQYYLQLNSVTTEDTATYYCAGDYGSPYAMDYWGQGTSVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 269 - protein, 452 aa, Artificial
  antibody sequence
QVQLQQSGAELAKPGASVKMSCKSSGYTFSTYWMHWVKQRPGQGLEWIGYINPNTGYTEYNQKFKDTATLTADKSSSTAYMQLSSLTSEDSAVYYCARGGSKAFPYYAMDYWGQGTSVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 270 - protein, 449 aa, Artificial
  antibody sequence
EIQLQQSGPELVKPGASVKMSCKASGYSFTGYNMHWVKQSHGKSLEWIGYIDPYNGATSHNQKFKGKATLTVEKSSSTAYMQLNSLTSEDSAVYYCARGLYGDYWYAYWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 271 - protein, 448 aa, Artificial
  antibody sequence
EVQLVESGGGLVKPGGSLKLSCAASGFTFSDYYMYWVRQTPEKRLEWVATISDGGSYTFYPDSVKGRFTISRDNAKNNLYLQMSSLKSEDTAMYYCARGPTYYGLDYWGQGTTLTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 272 - protein, 447 aa, Artificial
  antibody sequence
QVQLQQPGAELVRPGASVRLSCKASGYSFTSYWMSWVKVRPGQGLEWIGMIHPSDSETRLNQKFKDKATLTVDKSSSTAYMQLSSPTSEDSAVYYCARLYVDFFDYWGQGTTLTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 273 - protein, 448 aa, Artificial
  antibody sequence
DVKLVESGGGLVKLGGSLKLSCAASGFTFSSYYMSWVRQTPEKRLELVAAINSNGGSTYYPDTVKGRFTISRDNAKNTLYLQMSSLKSEDTALYYCARPDYPYAMDYWGQGTSVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 274 - protein, 452 aa, Artificial
  antibody sequence
QIQLVQSGPELKKPGETVKISCKASGYTFTNYGMNWVKQAPGKGLKWMGWINTYTGEPTYADDFKGRFAFSLETSASTAYLQINNLKNEDTATYFCARSPSYGSRGAWFAYWSQGTLVTVSAAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 275 - protein, 452 aa, Artificial
  antibody sequence
QIQLVQSGPELKKPGETVKISCKASGYTFTNYGMNWVKQAPGKGLKWMGWINTYTGEPTYADDFKGRFAFSLETSASTAYLQINNLKNEDTATYFCARSPSYGSRGAWFAYWGQGTLVTVSAAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 276 - protein, 446 aa, Artificial
  antibody sequence
QVQLQQSGAELMKPGASVKISCKASGYTFSDYWIEWIKQRPGHGLEWMGEILPGSDKTNYNEKFKGKATFTADSSSNTAYMQLNSLTSEDSAVFYCATAGDDYVKWGQGTLVTVSAAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 277 - protein, 444 aa, Artificial
  antibody sequence
EVQLQQSGAELVKPGASVKLSCTASGFNIKDTYMHWVRQRPEQGLEWIGRIDPANDITKYDPKFQGKATITADTSSNTAYLQLSSLTSEDTAVYYCGRDWADYWGQGTTLTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 278 - protein, 444 aa, Artificial
  antibody sequence
EVQLQQSGAELVKPGASVKLSCTASGFNIKDTYMHWVKQRSEQGLEWIGRINPANDNTKYDPKFQGKATITADTSSNTAYLQLSSLTSEDTAVYYCGRDWADYWGQGTTLTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 279 - protein, 449 aa, Artificial
  antibody sequence
QVQLQQPGAELVKPGASVKLSCKASGYTFTRYWMHWVKQRPGQGLEWIGEINPNNGHTNYNEKFESRATLTVDKSSSTAYMQFNSLTSEDSAVYYCGRLDGHLYAVDYWGQGTSVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 280 - protein, 449 aa, Artificial
  antibody sequence
QVQLQQPGTELKMPGTSVKLSCKASGYTFTTYWMHWVKLRPGQGFEWIGEINPSNDGTNYNEKFKRKATLTVDKPSSTAYMQLSSLTSEDSTIYYCTISYYGYGDFDYWGQGTTLTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 281 - protein, 449 aa, Artificial
  antibody sequence
QVQLKESGPDLVQPSQTLSLTCTVSGFSLTSYGVHWVRQPPGKGLEWVGTMGWNDKKYYNSALKSRLSISRNTSKNQVFLKLSSLQTEDTAMYYCTRDGDSSGSWFAYWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 282 - protein, 447 aa, Artificial
  antibody sequence
QVQLKESGPDLVQPSQTLSLTCTVSGFSLTGYAVHWVRQPPGKGVEWVGTMGWDDKKFYNSALKSRLSISRDPSKNQVFFKLSSLQTEDTAMYYCTRDHGDGGFAYWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 283 - protein, 451 aa, Artificial
  antibody sequence
EVQLQQSGPELVKPGASVKIPCKASGYTFTDYNMDWVKQSHGKSLEWIGNINPNNGGTIYNQNFKDRATLTVDKSSSTAYMELRSLTSEDTAVYYCTRENSGYGGNYFAYWGQGTTLTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 284 - protein, 444 aa, Artificial
  antibody sequence
EVQLQQSGAELVRPGASVKLSCTTSGFNIKDSLIYWVKQRPEQGLEWIGWIDPEDGETKFAPRFQDKATITSDTSSNTAYLRLSSLTSEDTAIYYCTRSFGVCWGQGTLVTVSAAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 285 - protein, 444 aa, Artificial; identical to SEQ ID NO: 284
  antibody sequence

SEQ ID NO: 286 - protein, 444 aa, Artificial; identical to SEQ ID NO: 284
  antibody sequence

SEQ ID NO: 287 - protein, 7 aa, Artificial
  antibody sequence
GYTFTDY

SEQ ID NO: 288 - protein, 7 aa, Artificial
  antibody sequence
GYSFTGY

SEQ ID NO: 289 - protein, 7 aa, Artificial
  antibody sequence
GFSLTGY

SEQ ID NO: 290 - protein, 7 aa, Artificial
  antibody sequence
GFTFSSF

SEQ ID NO: 291 - protein, 9 aa, Artificial
  antibody sequence
GYSITNGNH

SEQ ID NO: 292 - protein, 6 aa, Artificial
  antibody sequence
NPYNGD

SEQ ID NO: 293 - protein, 5 aa, Artificial
  antibody sequence
WGDGS

SEQ ID NO: 294 - protein, 6 aa, Artificial
  antibody sequence
SCYSGA

SEQ ID NO: 295 - protein, 6 aa, Artificial
  antibody sequence
SSGSSF

SEQ ID NO: 296 - protein, 5 aa, Artificial
  antibody sequence
SSSGS

SEQ ID NO: 297 - protein, 5 aa, Artificial
  antibody sequence
GNFFD

SEQ ID NO: 298 - protein, 7 aa, Artificial
  antibody sequence
SYGYAMD

SEQ ID NO: 299 - protein, 10 aa, Artificial
  antibody sequence
KGGNSPYAMD

SEQ ID NO: 300 - protein, 8 aa, Artificial
  antibody sequence
GESYYVMD

SEQ ID NO: 301 - protein, 12 aa, Artificial
  antibody sequence
EGIYFYDSRYFD

SEQ ID NO: 302 - protein, 12 aa, Artificial
  antibody sequence
GHYYDGSSYAMD

SEQ ID NO: 303 - protein, 6 aa, Artificial
  antibody sequence
SSSVSY

SEQ ID NO: 304 - protein, 12 aa, Artificial
  antibody sequence
SQTIVHSNGNTY

SEQ ID NO: 305 - protein, 8 aa, Artificial
  antibody sequence
SSSVSSSY

SEQ ID NO: 306 - protein, 12 aa, Artificial
  antibody sequence
SQSLVHSNGNTY

SEQ ID NO: 307 - protein, 7 aa, Artificial
  antibody sequence
SQDINSY

SEQ ID NO: 308 - protein, 12 aa, Artificial
  antibody sequence
SQDIVHSNGNTY

SEQ ID NO: 309 - protein, 11 aa, Artificial
  antibody sequence
SESVDSYGNSF

SEQ ID NO: 310 - protein, 3 aa, Artificial
  antibody sequence
STS

SEQ ID NO: 311 - protein, 3 aa, Artificial
  antibody sequence
KVS

SEQ ID NO: 312 - protein, 3 aa, Artificial
  antibody sequence
RAN

SEQ ID NO: 313 - protein, 3 aa, Artificial
  antibody sequence
RAS

SEQ ID NO: 314 - protein, 6 aa, Artificial
  antibody sequence
RSNYPL

SEQ ID NO: 315 - protein, 6 aa, Artificial
  antibody sequence
GSHVPF

SEQ ID NO: 316 - protein, 6 aa, Artificial
  antibody sequence
WTTFPP

SEQ ID NO: 317 - protein, 6 aa, Artificial
  antibody sequence
STHVPP

SEQ ID NO: 318 - protein, 6 aa, Artificial
  antibody sequence
STHVPL

SEQ ID NO: 319 - protein, 6 aa, Artificial
  antibody sequence
RSSYPW

SEQ ID NO: 320 - protein, 6 aa, Artificial
  antibody sequence
YDEFPY

SEQ ID NO: 321 - protein, 6 aa, Artificial
  antibody sequence
SSHFPW

SEQ ID NO: 322 - protein, 6 aa, Artificial
  antibody sequence
STHVPF

SEQ ID NO: 323 - protein, 6 aa, Artificial
  antibody sequence
SNEDPL

SEQ ID NO: 324 - protein, 106 aa, Artificial
  antibody sequence
DIVMTQSPAIMSASPGEKVTIPCSASSSVSYMHWFQQKPGTSPKLWIYSTSNLASGVPGRFSGSGSGTSYSLTISRMEAEDAATYYCQQRSNYPLTFGAGTKLELK

SEQ ID NO: 325 - protein, 112 aa, Artificial
  antibody sequence
DVVMTQTPLSLPVSLGDQASISCRSSQTIVHSNGNTYLEWYLQKPGQSPKLLIYKVSNRFSGVPDRFSGSGSGTDFTLKISRVEAEDLGVYYCFQGSHVPFTFGGGTKLEIR

SEQ ID NO: 326 - protein, 108 aa, Artificial
  antibody sequence
DIVMTQAAAIMSASPGEKVTLTCSASSSVSSSYLYWYQQKPGSSPKLWIYSTSNLASGVPARFSGSGSGTSYSLTISSMEAEDAASYFCHQWTTFPPTFGGGTKLEIK

SEQ ID NO: 327 - protein, 112 aa, Artificial
  antibody sequence
DVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPPTFGGGTKLEIK

SEQ ID NO: 328 - protein, 112 aa, Artificial
  antibody sequence
DVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPLTFGAGTKLELK

SEQ ID NO: 329 - protein, 112 aa, Artificial
  antibody sequence
DIKMTQSPLSLPVSLGDQASISCRSSQTIVHSNGNTYLEWYLQKPGQSPKLLIYKVSNRFSGVPDRFSGSGSGTDFTLKISRVEAEDLGVYYCFQGSHVPFTFGGGTKLEIR

SEQ ID NO: 330 - protein, 106 aa, Artificial
  antibody sequence
DIVLTQSPAIMSASPGEKVTITCSASSSVSYMHWFQQKPGTSPKLWIYSTSNLASGVPARFSGSGSGTSYSLTISRMEAEDAATYYCQQRSSYPWTFGGGTKLEIK

SEQ ID NO: 331 - protein, 107 aa, Artificial
  antibody sequence
DIVMTQSPSSMYASLGERVTITCKASQDINSYLSWFQQKPGKSPKTLIYRANRLVDGVPSRFSGSGSGQDYSLTISSLEYEDMGIYYCLQYDEFPYTFGGGTKLEIK

SEQ ID NO: 332 - protein, 112 aa, Artificial
  antibody sequence
DIVMTQSPLSLPVSLGDQASISCRSSQDIVHSNGNTYLGWYLQKPGRSPKLLIYKVSNRFSGVPDRFSGSGSGTDFTLKISRVEAEDLGVYYCFQSSHFPWTFGGGTRLEIK

SEQ ID NO: 333 - protein, 112 aa, Artificial
  antibody sequence
DVVMTQTPLSLPVSLGDQASISCRSSQDIVHSNGNTYLGWYLQKPGRSPKLLIYKVSNRFSGVPDRFSGSGSGTDFTLKISRVEAEDLGVYYCFQSSHFPWTFGGGTRLEIK

SEQ ID NO: 334 - protein, 112 aa, Artificial
  antibody sequence
DIVLTQSPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPFTFGSGTKLEIK

SEQ ID NO: 335 - protein, 111 aa, Artificial
  antibody sequence
DIVLTQSPASLAVSLGQRATISCRASESVDSYGNSFMHWYQQKPGQPPKLLIYRASNLESGIPARFSGSGSRTDFTLTINPVEADDVATYYCQQSNEDPLTFGAGTKLELK

SEQ ID NO: 336 - protein, 115 aa, Artificial
  antibody sequence
EVQLQQSGAELVKPGASVKMSCKASGYTFTDYYMDWVKQSHGKSFEWIGHVNPYNGDTRYNQKFKGKATLTVDKSSTTAYMELNSLTSEDSAVYYCARGNFFDYWGQGTTLSVSS

SEQ ID NO: 337 - protein, 117 aa, Artificial
  antibody sequence
EVQLQQSGAELVKPGASVKISCKTSGYSFTGYFMNWVMQSHGKSLEWIGRINPYNGDTFYNQKFKGKATLTVDKSSSTAHMELRSLASEDSAVYYCARSYGYAMDYWGQGTSVTVSS

SEQ ID NO: 338 - protein, 119 aa, Artificial
  antibody sequence
QVQLKESGPGLVAPSQSLSITCTVSGFSLTGYGVNWVRQPPGKGLEWLGLMWGDGSTDYNSALNSRLRINKDNSKSQVFLKMSSLQTDDTAIYYCVRKGGNSPYAMDYWGQGTSVTVSS

SEQ ID NO: 339 - protein, 119 aa, Artificial; identical to SEQ ID NO: 338
  antibody sequence

SEQ ID NO: 340 - protein, 117 aa, Artificial
  antibody sequence
EVKLVESGPELVKPGASVKISCKTSGYSFTGYFMNWVMQSHGKSLEWIGRINPYNGDTFYNQKFKGKATLTVDKSSSTAHMELRSLASEDSAVYYCARSYGYAMDYWGQGTSVTVSS

SEQ ID NO: 341 - protein, 117 aa, Artificial; identical to SEQ ID NO: 340
  antibody sequence

SEQ ID NO: 342 - protein, 117 aa, Artificial
  antibody sequence
EVQLQQSGPELVKPGASVKISCKASGYSFTGYFMNWVMQSHGKSLEWIGRINPYNGDTFYNQKFKAKATLTVDKSSNTAHMELRSLASEDSAVYFCARSYGYAMDYWGLGTSVTVSS

SEQ ID NO: 343 - protein, 118 aa, Artificial
  antibody sequence
EVQLQQSGPELVKTGASVKISCKASGYSFTGYYMHWVKQSHGKSLEWIGYLSCYSGATSYNQKFKGKATFTVDTSSTTAYMQFNSLTSEDSAVYYCARGESYYVMDYWGQGTSVTVSS

SEQ ID NO: 344 - protein, 122 aa, Artificial
  antibody sequence
EVQLQQSGGGSVQPGGSRKLSCAASGFTFSSFGMHWVRQAPEKGLEWVAYISSGSSFIYYGDTVKGRFTISRDNPNNTLFLQMTSLRSEDTAIYYCAREGIYFYDSRYFDVWGAGTTVTVSS

SEQ ID NO: 345 - protein, 122 aa, Artificial; identical to SEQ ID NO: 344
  antibody sequence

SEQ ID NO: 346 - protein, 118 aa, Artificial
  antibody sequence
EFQLQQSGPELVKTGASVKISCKASGYSFTGYYMHWVKQSHGRSLEWIGYLSCYSGATSYNQKFKGKATFTVDTSSTTAYMQFNSLTSEDSAVYYCARGESYYVMDYWGQGTSVTVSS

SEQ ID NO: 347 - protein, 123 aa, Artificial
  antibody sequence
EVQLQQSGPGLVKPSQTVSLTCTVTGYSITNGNHWWNWIRQVSGSKLEWIGYISSSGSTDSNPSLKSRISITRDTSKNQLFLQLNSVTTEDIATYYCARGHYYDGSSYAMDYWGQGTSVTVSS

SEQ ID NO: 348 - protein, 213 aa, Artificial
  antibody sequence
DIVMTQSPAIMSASPGEKVTIPCSASSSVSYMHWFQQKPGTSPKLWIYSTSNLASGVPGRFSGSGSGTSYSLTISRMEAEDAATYYCQQRSNYPLTFGAGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 349 - protein, 219 aa, Artificial
  antibody sequence
DVVMTQTPLSLPVSLGDQASISCRSSQTIVHSNGNTYLEWYLQKPGQSPKLLIYKVSNRFSGVPDRFSGSGSGTDFTLKISRVEAEDLGVYYCFQGSHVPFTFGGGTKLEIRRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 350 - protein, 215 aa, Artificial
  antibody sequence
DIVMTQAAAIMSASPGEKVTLTCSASSSVSSSYLYWYQQKPGSSPKLWIYSTSNLASGVPARFSGSGSGTSYSLTISSMEAEDAASYFCHQWTTFPPTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 351 - protein, 219 aa, Artificial
  antibody sequence
DVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPPTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 352 - protein, 219 aa, Artificial
  antibody sequence
DVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPLTFGAGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 353 - protein, 219 aa, Artificial
  antibody sequence
DIKMTQSPLSLPVSLGDQASISCRSSQTIVHSNGNTYLEWYLQKPGQSPKLLIYKVSNRFSGVPDRFSGSGSGTDFTLKISRVEAEDLGVYYCFQGSHVPFTFGGGTKLEIRRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 354 - protein, 213 aa, Artificial
  antibody sequence
DIVLTQSPAIMSASPGEKVTITCSASSSVSYMHWFQQKPGTSPKLWIYSTSNLASGVPARFSGSGSGTSYSLTISRMEAEDAATYYCQQRSSYPWTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 355 - protein, 214 aa, Artificial
  antibody sequence
DIVMTQSPSSMYASLGERVTITCKASQDINSYLSWFQQKPGKSPKTLIYRANRLVDGVPSRFSGSGSGQDYSLTISSLEYEDMGIYYCLQYDEFPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 356 - protein, 219 aa, Artificial
  antibody sequence
DIVMTQSPLSLPVSLGDQASISCRSSQDIVHSNGNTYLGWYLQKPGRSPKLLIYKVSNRFSGVPDRFSGSGSGTDFTLKISRVEAEDLGVYYCFQSSHFPWTFGGGTRLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 357 - protein, 219 aa, Artificial
  antibody sequence
DVVMTQTPLSLPVSLGDQASISCRSSQDIVHSNGNTYLGWYLQKPGRSPKLLIYKVSNRFSGVPDRFSGSGSGTDFTLKISRVEAEDLGVYYCFQSSHFPWTFGGGTRLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 358 - protein, 219 aa, Artificial
  antibody sequence
DIVLTQSPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPFTFGSGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 359 - protein, 218 aa, Artificial
  antibody sequence
DIVLTQSPASLAVSLGQRATISCRASESVDSYGNSFMHWYQQKPGQPPKLLIYRASNLESGIPARFSGSGSRTDFTLTINPVEADDVATYYCQQSNEDPLTFGAGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 360 - protein, 439 aa, Artificial
  antibody sequence
EVQLQQSGAELVKPGASVKMSCKASGYTFTDYYMDWVKQSHGKSFEWIGHVNPYNGDTRYNQKFKGKATLTVDKSSTTAYMELNSLTSEDSAVYYCARGNFFDYWGQGTTLSVSSAKTTPPSVYPLAPGSAAQTNSMVTLGCLVKGYFPEPVTVTWNSGSLSSGVHTFPAVLESDLYTLSSSVTVPSSPRPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMNTNGSYFVYSKLNVQKSNWEAGNTFTCSVLHEGLHNHHTEKSLSHSPGK

SEQ ID NO: 361 - protein, 441 aa, Artificial
  antibody sequence
EVQLQQSGAELVKPGASVKISCKTSGYSFTGYFMNWVMQSHGKSLEWIGRINPYNGDTFYNQKFKGKATLTVDKSSSTAHMELRSLASEDSAVYYCARSYGYAMDYWGQGTSVTVSSAKTTPPSVYPLAPGSAAQTNSMVTLGCLVKGYFPEPVTVTWNSGSLSSGVHTFPAVLESDLYTLSSSVTVPSSPRPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMNTNGSYFVYSKLNVQKSNWEAGNTFTCSVLHEGLHNHHTEKSLSHSPGK

SEQ ID NO: 362 - protein, 443 aa, Artificial
  antibody sequence
QVQLKESGPGLVAPSQSLSITCTVSGFSLTGYGVNWVRQPPGKGLEWLGLMWGDGSTDYNSALNSRLRINKDNSKSQVFLKMSSLQTDDTAIYYCVRKGGNSPYAMDYWGQGTSVTVSSAKTTPPSVYPLAPGSAAQTNSMVTLGCLVKGYFPEPVTVTWNSGSLSSGVHTFPAVLESDLYTLSSSVTVPSSPRPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMNTNGSYFVYSKLNVQKSNWEAGNTFTCSVLHEGLHNHHTEKSLSHSPGK

SEQ ID NO: 363 - protein, 443 aa, Artificial; identical to SEQ ID NO: 362
  antibody sequence

SEQ ID NO: 364 - protein, 441 aa, Artificial
  antibody sequence
EVKLVESGPELVKPGASVKISCKTSGYSFTGYFMNWVMQSHGKSLEWIGRINPYNGDTFYNQKFKGKATLTVDKSSSTAHMELRSLASEDSAVYYCARSYGYAMDYWGQGTSVTVSSAKTTPPSVYPLAPGSAAQTNSMVTLGCLVKGYFPEPVTVTWNSGSLSSGVHTFPAVLESDLYTLSSSVTVPSSPRPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMNTNGSYFVYSKLNVQKSNWEAGNTFTCSVLHEGLHNHHTEKSLSHSPGK

SEQ ID NO: 365 - protein, 441 aa, Artificial; identical to SEQ ID NO: 364
  antibody sequence

SEQ ID NO: 366 - protein, 441 aa, Artificial
  antibody sequence
EVQLQQSGPELVKPGASVKISCKASGYSFTGYFMNWVMQSHGKSLEWIGRINPYNGDTFYNQKFKAKATLTVDKSSNTAHMELRSLASEDSAVYFCARSYGYAMDYWGLGTSVTVSSAKTTPPSVYPLAPGSAAQTNSMVTLGCLVKGYFPEPVTVTWNSGSLSSGVHTFPAVLESDLYTLSSSVTVPSSPRPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMNTNGSYFVYSKLNVQKSNWEAGNTFTCSVLHEGLHNHHTEKSLSHSPGK

SEQ ID NO: 367 - protein, 442 aa, Artificial
  antibody sequence
EVQLQQSGPELVKTGASVKISCKASGYSFTGYYMHWVKQSHGKSLEWIGYLSCYSGATSYNQKFKGKATFTVDTSSTTAYMQFNSLTSEDSAVYYCARGESYYVMDYWGQGTSVTVSSAKTTPPSVYPLAPGSAAQTNSMVTLGCLVKGYFPEPVTVTWNSGSLSSGVHTFPAVLESDLYTLSSSVTVPSSPRPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMNTNGSYFVYSKLNVQKSNWEAGNTFTCSVLHEGLHNHHTEKSLSHSPGK

SEQ ID NO: 368 - protein, 446 aa, Artificial
  antibody sequence
EVQLQQSGGGSVQPGGSRKLSCAASGFTFSSFGMHWVRQAPEKGLEWVAYISSGSSFIYYGDTVKGRFTISRDNPNNTLFLQMTSLRSEDTAIYYCAREGIYFYDSRYFDVWGAGTTVTVSSAKTTPPSVYPLAPGSAAQTNSMVTLGCLVKGYFPEPVTVTWNSGSLSSGVHTFPAVLESDLYTLSSSVTVPSSPRPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMNTNGSYFVYSKLNVQKSNWEAGNTFTCSVLHEGLHNHHTEKSLSHSPGK

SEQ ID NO: 369 - protein, 446 aa, Artificial; identical to SEQ ID NO: 368
  antibody sequence

SEQ ID NO: 370 - protein, 468 aa, Artificial
  antibody sequence
DVQLQESGPGHSMVTLGCLVGQSIQAEFQLQQSGPELVKTGASVKISCKASGYSFTGYYMHWVKQSHGRSLEWIGYLSCYSGATSYNQKFKGKATFTVDTSSTTAYMQFNSLTSEDSAVYYCARGESYYVMDYWGQGTSVTVSSAKTTPPSVYPLAPGSAAQTNSMVTLGCLVKGYFPEPVTVTWNSGSLSSGVHTFPAVLESDLYTLSSSVTVPSSPRPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMNTNGSYFVYSKLNVQKSNWEAGNTFTCSVLHEGLHNHHTEKSLSHSPGK

SEQ ID NO: 371 - protein, 447 aa, Artificial
  antibody sequence
EVQLQQSGPGLVKPSQTVSLTCTVTGYSITNGNHWWNWIRQVSGSKLEWIGYISSSGSTDSNPSLKSRISITRDTSKNQLFLQLNSVTTEDIATYYCARGHYYDGSSYAMDYWGQGTSVTVSSAKTTAPSVYPLAPVCGDTSDSMVTLGCLVKGYFPEPVTVTWNSGSLSSGVHTFPAVLESDLYTLSSSVTVPSSPRPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMNTNGSYFVYSKLNVQKSNWEAGNTFTCSVLHEGLHNHHTEKSLSHSPGK

SEQ ID NO: 372 - protein, 7 aa, Artificial
  antibody sequence
GYTFTDY

SEQ ID NO: 373 - protein, 7 aa, Artificial
  antibody sequence
GFTFSSY

SEQ ID NO: 374 - protein, 7 aa, Artificial
  antibody sequence
GYTFTSY

SEQ ID NO: 375 - protein, 6 aa, Artificial
  antibody sequence
DTSDSY

SEQ ID NO: 376 - protein, 6 aa, Artificial
  antibody sequence
FPGNSD

SEQ ID NO: 377 - protein, 6 aa, Artificial
  antibody sequence
DASDSY

SEQ ID NO: 378 - protein, 6 aa, Artificial
  antibody sequence
TGGGTY

SEQ ID NO: 379 - protein, 6 aa, Artificial
  antibody sequence
NPYNAD

SEQ ID NO: 380 - protein, 7 aa, Artificial
  antibody sequence
DYGYAMD

SEQ ID NO: 381 - protein, 4 aa, Artificial
  antibody sequence
TELD

SEQ ID NO: 382 - protein, 10 aa, Artificial
  antibody sequence
HRDGNYGCFD

SEQ ID NO: 383 - protein, 4 aa, Artificial
  antibody sequence
SAMD

SEQ ID NO: 384 - protein, 6 aa, Artificial
  antibody sequence
SLSVSY

SEQ ID NO: 385 - protein, 12 aa, Artificial
  antibody sequence
SQSLIHNDGNTY

SEQ ID NO: 386 - protein, 6 aa, Artificial
  antibody sequence
SSSVSF

SEQ ID NO: 387 - protein, 8 aa, Artificial
  antibody sequence
SSSVSSSY

SEQ ID NO: 388 - protein, 3 aa, Artificial
  antibody sequence
SAS

SEQ ID NO: 389 - protein, 3 aa, Artificial
  antibody sequence
KVS

SEQ ID NO: 390 - protein, 3 aa, Artificial
  antibody sequence
STS

SEQ ID NO: 391 - protein, 3 aa, Artificial
  antibody sequence
DTS

SEQ ID NO: 392 - protein, 6 aa, Artificial
  antibody sequence
RSSYPF

SEQ ID NO: 393 - protein, 6 aa, Artificial
  antibody sequence
STHVPF

SEQ ID NO: 394 - protein, 6 aa, Artificial
  antibody sequence
RSTYPY

SEQ ID NO: 395 - protein, 6 aa, Artificial
  antibody sequence
YHRSPQ

SEQ ID NO: 396 - protein, 6 aa, Artificial
  antibody sequence
RSSYPY

SEQ ID NO: 397 - protein, 6 aa, Artificial
  antibody sequence
GSGYPL

SEQ ID NO: 398 - protein, 106 aa, Artificial
  antibody sequence
QIVLTQSPAIMSASPGEKVTITCSASLSVSYMHWFQQKPGTSPKLWIYSASNLASGVPARFSGSGSGTSYSLTISRMEAEDAATYYCQQRSSYPFTFGSGTKLEIK

SEQ ID NO: 399 - protein, 112 aa, Artificial
  antibody sequence
DVVMTQTPLSLPVSLGDQASISCRSSQSLIHNDGNTYLHWYLQKPGQSPKLLIYKVSNRFSGVPDRFSGSGSGTDFTVKISRVEAEDLGVYFCSQSTHVPFTFGAGTKLELK

SEQ ID NO: 400 - protein, 106 aa, Artificial
  antibody sequence
QIVLSQSPAIMSASPGEKVTITCSASLSVSFMHWFQQKPGTSPKLWIYSASNLASGVPARFSGSGSGTSYSLTISRMEAEDAATYYCQQRSSYPFTFGSGTKLEIK

SEQ ID NO: 401 - protein, 106 aa, Artificial
  antibody sequence
QIVLTQSPAIMSASPGEKVTITCSASSSVSFMHWFQQKPGTSPKLWIYSTSNLASGVPARFSGSGSGTSYSLTISRMEAEDAATYYCQQRSTYPYTFGGGTKMEIK

SEQ ID NO: 402 - protein, 108 aa, Artificial
  antibody sequence
DIVLTQSPAIMSASLGERVTMTCTASSSVSSSYLHWYQQKPGSSPKLWVYSTSNLASGVPARFSGSGSGSSYSLTISSMEPEDTATYYCHQYHRSPQTFGGGTKLEIK

SEQ ID NO: 403 - protein, 106 aa, Artificial
  antibody sequence
QIVLTQSPAIMSASPGEKVTITCSASSSVSFMHWFQQKPGTSPKLWIYSASNLASGVPARFSGSGSGTSYSLTISRMEAEDAATYYCQQRSSYPYTFGGGTKLEIK

SEQ ID NO: 404 - protein, 106 aa, Artificial
  antibody sequence
DIVLTQSPAIMSASPGEKVTMTCSASSSVSYMHWYQQKSSTSPKLWIYDTSKLASGVPGRFSGSGSGNSYSLTISSMEAEDVATYYCFQGSGYPLTFGSGTKLEIK

SEQ ID NO: 405 - protein, 106 aa, Artificial
  antibody sequence
QIVLTQSPAIMSASPGEKVTITCSASSSVSYMHWFQQKPGTSPKLWIYSASNLASGVPARFSGSGSGTSYSLTISRMEAEDAATYYCQQRSSYPFTFGSGTKLEIK

SEQ ID NO: 406 - protein, 117 aa, Artificial
  antibody sequence
QVQLQQSGAELVMPGASVKMSCKASGYTFTDYWMHWVKQRPGQGLEWIGAIDTSDSYTSYNQKFKGKATLTVDESSSTAYMQLSSLTSEDSAVYYCARDYGYAMDYWGQGTSVTVSS

SEQ ID NO: 407 - protein, 114 aa, Artificial
  antibody sequence
EVQLQQSGAMLARPGASVTMSCKASGYTFTDYWMHWVRQGPGQGLEWIGAIFPGNSDTTYNQKFRGKAKLTAVTSAITAYMEVSSLTNIDSAVYYCTVTELDYWGQGTTLTVSS

SEQ ID NO: 408 - protein, 117 aa, Artificial
  antibody sequence
EVQLQQSGADLVMPGTSMKLSCKASGYTFTDYWIHWVKQGPGQGLEWIGAIDTSDSYINYNQKFTDKATLTVDESSSTAYMHLSSLTSEDSAVYYCARDYGYAMDYWGQGTSVTVSS

SEQ ID NO: 409 - protein, 117 aa, Artificial
  antibody sequence
QVQLQQPGAELVMPGSSVKMSCKASGYTFTDYWMHWVKQRPGQGLEWIGAIDASDSYTSYDQKFKGKATLTVDDSSSTAYIHLNSLTSEDSAVYYCARDFGYAMDYWGQGTSVTVSS

SEQ ID NO: 410 - protein, 120 aa, Artificial
  antibody sequence
EVQLQQSGGGLVKPGGSLKLSCAASGFTFSSYAMSWVRQTPEKRLEWVATITGGGTYTYYLDSVKGRFTISRDNAKTSLYLQMSSLRSEDTAMYYCARHRDGNYGCFDVWGAGTTVTVSS

SEQ ID NO: 411 - protein, 117 aa, Artificial
  antibody sequence
EVQLQQSGAELVMPGASVKMSCKASGYTFTDYWMHWVLQRPGQGLEWIGAIDTSDSYTTYNQKFKGKATLTVDESSSTAYMLLSSLTSEDSAVYYCARDYGYAMDYWGQGSSVTVSS

SEQ ID NO: 412 - protein, 114 aa, Artificial
  antibody sequence
EFQLQQSGPELVKPGASVKMSCKASGYTFTSYFIHWVKQKPGQGLEWIGFINPYNADTNYNEKFKGKATLTSDKSSSTAYMELSSLTSEDSAVYYCTPSAMDYWGQGTSVTVSS

SEQ ID NO: 413 - protein, 117 aa, Artificial
  antibody sequence
QVQLQQSGAELVMPGASVKMSCKASGYTFTDYWMHWVKQRPGQGLEWIGAIDTSDSYTTYNQKFKGKATLTVDESSSTAYMQLSSLTSEDSAVYYCARDYGYAMDYWGQGTSVTVSS

SEQ ID NO: 414 - protein, 213 aa, Artificial
  antibody sequence
QIVLTQSPAIMSASPGEKVTITCSASLSVSYMHWFQQKPGTSPKLWIYSASNLASGVPARFSGSGSGTSYSLTISRMEAEDAATYYCQQRSSYPFTFGSGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 415 - protein, 219 aa, Artificial
  antibody sequence
DVVMTQTPLSLPVSLGDQASISCRSSQSLIHNDGNTYLHWYLQKPGQSPKLLIYKVSNRFSGVPDRFSGSGSGTDFTVKISRVEAEDLGVYFCSQSTHVPFTFGAGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 416 - protein, 213 aa, Artificial
  antibody sequence
QIVLSQSPAIMSASPGEKVTITCSASLSVSFMHWFQQKPGTSPKLWIYSASNLASGVPARFSGSGSGTSYSLTISRMEAEDAATYYCQQRSSYPFTFGSGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 417 - protein, 213 aa, Artificial
  antibody sequence
QIVLTQSPAIMSASPGEKVTITCSASSSVSFMHWFQQKPGTSPKLWIYSTSNLASGVPARFSGSGSGTSYSLTISRMEAEDAATYYCQQRSTYPYTFGGGTKMEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 418 - protein, 215 aa, Artificial
  antibody sequence
DIVLTQSPAIMSASLGERVTMTCTASSSVSSSYLHWYQQKPGSSPKLWVYSTSNLASGVPARFSGSGSGSSYSLTISSMEPEDTATYYCHQYHRSPQTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 419 - protein, 213 aa, Artificial
  antibody sequence
QIVLTQSPAIMSASPGEKVTITCSASSSVSFMHWFQQKPGTSPKLWIYSASNLASGVPARFSGSGSGTSYSLTISRMEAEDAATYYCQQRSSYPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 420 - protein, 213 aa, Artificial
  antibody sequence
DIVLTQSPAIMSASPGEKVTMTCSASSSVSYMHWYQQKSSTSPKLWIYDTSKLASGVPGRFSGSGSGNSYSLTISSMEAEDVATYYCFQGSGYPLTFGSGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 421 - protein, 213 aa, Artificial
  antibody sequence
QIVLTQSPAIMSASPGEKVTITCSASSSVSYMHWFQQKPGTSPKLWIYSASNLASGVPARFSGSGSGTSYSLTISRMEAEDAATYYCQQRSSYPFTFGSGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 422 - protein, 441 aa, Artificial
  antibody sequence
QVQLQQSGAELVMPGASVKMSCKASGYTFTDYWMHWVKQRPGQGLEWIGAIDTSDSYTSYNQKFKGKATLTVDESSSTAYMQLSSLTSEDSAVYYCARDYGYAMDYWGQGTSVTVSSAKTTPPSVYPLAPGSAAQTNSMVTLGCLVKGYFPEPVTVTWNSGSLSSGVHTFPAVLESDLYTLSSSVTVPSSPRPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMNTNGSYFVYSKLNVQKSNWEAGNTFTCSVLHEGLHNHHTEKSLSHSPGK

SEQ ID NO: 423 - protein, 438 aa, Artificial
  antibody sequence
EVQLQQSGAMLARPGASVTMSCKASGYTFTDYWMHWVRQGPGQGLEWIGAIFPGNSDTTYNQKFRGKAKLTAVTSAITAYMEVSSLTNIDSAVYYCTVTELDYWGQGTTLTVSSAKTTPPSVYPLAPGSAAQTNSMVTLGCLVKGYFPEPVTVTWNSGSLSSGVHTFPAVLESDLYTLSSSVTVPSSPRPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMNTNGSYFVYSKLNVQKSNWEAGNTFTCSVLHEGLHNHHTEKSLSHSPGK

SEQ ID NO: 424 - protein, 441 aa, Artificial
  antibody sequence
EVQLQQSGADLVMPGTSMKLSCKASGYTFTDYWIHWVKQGPGQGLEWIGAIDTSDSYINYNQKFTDKATLTVDESSSTAYMHLSSLTSEDSAVYYCARDYGYAMDYWGQGTSVTVSSAKTTPPSVYPLAPGSAAQTNSMVTLGCLVKGYFPEPVTVTWNSGSLSSGVHTFPAVLESDLYTLSSSVTVPSSPRPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMNTNGSYFVYSKLNVQKSNWEAGNTFTCSVLHEGLHNHHTEKSLSHSPGK

SEQ ID NO: 425 - protein, 441 aa, Artificial
  antibody sequence
QVQLQQPGAELVMPGSSVKMSCKASGYTFTDYWMHWVKQRPGQGLEWIGAIDASDSYTSYDQKFKGKATLTVDDSSSTAYIHLNSLTSEDSAVYYCARDFGYAMDYWGQGTSVTVSSAKTTPPSVYPLAPGSAAQTNSMVTLGCLVKGYFPEPVTVTWNSGSLSSGVHTFPAVLESDLYTLSSSVTVPSSPRPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMNTNGSYFVYSKLNVQKSNWEAGNTFTCSVLHEGLHNHHTEKSLSHSPGK

SEQ ID NO: 426 - protein, 444 aa, Artificial
  antibody sequence
EVQLQQSGGGLVKPGGSLKLSCAASGFTFSSYAMSWVRQTPEKRLEWVATITGGGTYTYYLDSVKGRFTISRDNAKTSLYLQMSSLRSEDTAMYYCARHRDGNYGCFDVWGAGTTVTVSSAKTTPPSVYPLAPGSAAQTNPMVTLGCLVKGYFPEPVTVTWNSGSLSSGVHTFPAVLESDLYTLSSSVTVPSSPRPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMNTNGSYFVYSKLNVQKSNWEAGNTFTCSVLHEGLHNHHTEKSLSHSPGK

SEQ ID NO: 427 - protein, 441 aa, Artificial
  antibody sequence
EVQLQQSGAELVMPGASVKMSCKASGYTFTDYWMHWVLQRPGQGLEWIGAIDTSDSYTTYNQKFKGKATLTVDESSSTAYMLLSSLTSEDSAVYYCARDYGYAMDYWGQGSSVTVSSAKTTPPSVYPLAPGSAAQTNSMVTLGCLVKGYFPEPVTVTWNSGSLSSGVHTFPAVLESDLYTLSSSVTVPSSPRPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMNTNGSYFVYSKLNVQKSNWEAGNTFTCSVLHEGLHNHHTEKSLSHSPGK

SEQ ID NO: 428 - protein, 438 aa, Artificial
  antibody sequence
EFQLQQSGPELVKPGASVKMSCKASGYTFTSYFIHWVKQKPGQGLEWIGFINPYNADTNYNEKFKGKATLTSDKSSSTAYMELSSLTSEDSAVYYCTPSAMDYWGQGTSVTVSSAKTTPPSVYPLAPGSAAQTNSMVTLGCLVKGYFPEPVTVTWNSGSLSSGVHTFPAVLESDLYTLSSSVTVPSSPRPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMNTNGSYFVYSKLNVQKSNWEAGNTFTCSVLHEGLHNHHTEKSLSHSPGK

SEQ ID NO: 429 - protein, 441 aa, Artificial
  antibody sequence
QVQLQQSGAELVMPGASVKMSCKASGYTFTDYWMHWVKQRPGQGLEWIGAIDTSDSYTTYNQKFKGKATLTVDESSSTAYMQLSSLTSEDSAVYYCARDYGYAMDYWGQGTSVTVSSAKTTPPSVYPLAPGSAAQTNSMVTLGCLVKGYFPEPVTVTWNSGSLSSGVHTFPAVLESDLYTLSSSVTVPSSPRPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMNTNGSYFVYSKLNVQKSNWEAGNTFTCSVLHEGLHNHHTEKSLSHSPGK

SEQ ID NO: 430 - protein, 7 aa, Artificial
  antibody sequence
GYTFTIY

SEQ ID NO: 431 - protein, 7 aa, Artificial
  antibody sequence
GFTFSSY

SEQ ID NO: 432 - protein, 7 aa, Artificial
  antibody sequence
GFTFSNY

SEQ ID NO: 433 - protein, 6 aa, Artificial
  antibody sequence
NTYTGE

SEQ ID NO: 434 - protein, 6 aa, Artificial
  antibody sequence
NGNGGS

SEQ ID NO: 435 - protein, 5 aa, Artificial
  antibody sequence
SRRGS

SEQ ID NO: 436 - protein, 11 aa, Artificial
  antibody sequence
CYYKYEDYAMD

SEQ ID NO: 437 - protein, 9 aa, Artificial
  antibody sequence
HRADGPWFT

SEQ ID NO: 438 - protein, 9 aa, Artificial
  antibody sequence
VYYDNPWFV

SEQ ID NO: 439 - protein, 12 aa, Artificial
  antibody sequence
SQSLLDSDGKTY

SEQ ID NO: 440 - protein, 7 aa, Artificial
  antibody sequence
SEDIYIR

SEQ ID NO: 441 - protein, 3 aa, Artificial
  antibody sequence
VVS

SEQ ID NO: 442 - protein, 3 aa, Artificial
  antibody sequence
GAT

SEQ ID NO: 443 - protein, 3 aa, Artificial
  antibody sequence
LVS

SEQ ID NO: 444 - protein, 6 aa, Artificial
  antibody sequence
GTHFPL

SEQ ID NO: 445 - protein, 6 aa, Artificial
  antibody sequence
YWRTPL

SEQ ID NO: 446 - protein, 112 aa, Artificial
  antibody sequence
DVVMTQTPLTLSVTIGQPASISCKSSQSLLDSDGKTYLNWLLQRPGQSPKRLIYVVSKLDSGVPDRFTGSGSGTDFTLKISRVEAEDLGVYYCWQGTHFPLTFGAGTKLELK

SEQ ID NO: 447 - protein, 107 aa, Artificial
  antibody sequence
DVVMTQTPSSFSVSLGDGVTITCKASEDIYIRLAWYQQKPGNAPRLLIFGATSLETGVPSRFSGSGSGKDYTLSITSLQTEDVATYYCQQYWRTPLTFGAGTKLELK

SEQ ID NO: 448 - protein, 112 aa, Artificial
  antibody sequence
DVVMTQTPLTLSVTIGQPASISCKSSQSLLDSDGKTYLNWLLQRPGQSPKRLIYLVSKLDSGVPDRFTGSGSGTDFTLKISRVEAEDLGVYYCWQGTHFPLTFGAGTKLELK

SEQ ID NO: 449 - protein, 112 aa, Artificial; identical to SEQ ID NO: 448
  antibody sequence

SEQ ID NO: 450 - protein, 112 aa, Artificial; identical to SEQ ID NO: 446
  antibody sequence

SEQ ID NO: 451 - protein, 112 aa, Artificial; identical to SEQ ID NO: 446
  antibody sequence

SEQ ID NO: 452 - protein, 121 aa, Artificial
  antibody sequence
EVQLQQSGPELKKPGETVKISCKTSGYTFTIYGMNWMKQAPGKGLKWMGWINTYTGEPTYADDFKGRFAFSLETSASTAYLQINNLKNEDTATYFCARCYYKYEDYAMDYWGQGTSVTVSS

SEQ ID NO: 453 - protein, 119 aa, Artificial
  antibody sequence
EVKLVESGGGLVKPGGSLKLSCAASGFTFSSYAMSWVRQTPEKRLEWVAAINGNGGSTYYPDTVKDRFTISRDNAKNTLYLQMSSLRSEDTALYYCARHRADGPWFTYWGQGTLVTVSA

SEQ ID NO: 454 - protein, 118 aa, Artificial
  antibody sequence
EVKLVESGGGLVKPGGSLKLSCAASGFTFSNYAMSWVRQTPEKRLEWVASISRRGSTYYPDSVKGRFTISRDNARNILYLQMSSLRSEDTALYYCATVYYDNPWFVYWGQGTLVTVSA

SEQ ID NO: 455 - protein, 121 aa, Artificial
  antibody sequence
QIQLVQSGPELKKPGETVKISCKTSGYTFTIYGMNWTKQAPGKGLKWMGWINTYTGEPTYADDFKGRFAFSLETSASTAYLQINNLKNEDTATYFCARCYYKYEDYAMDYWGQGTSVTVSS

SEQ ID NO: 456 - protein, 119 aa, Artificial
  antibody sequence
DVKLVESGGGLVKPGGSLKLSCAASGFTFSSYAMSWVRQTPEKRLEWVAAINGNGGSTYYPDTVKDRFTISRDNAKNTLYLQMSSLRSEDTALYYCARHRADGPWFTYWGQGTLVTVSA

SEQ ID NO: 457 - protein, 118 aa, Artificial; identical to SEQ ID NO: 454
  antibody sequence

SEQ ID NO: 458 - protein, 219 aa, Artificial
  antibody sequence
DVVMTQTPLTLSVTIGQPASISCKSSQSLLDSDGKTYLNWLLQRPGQSPKRLIYVVSKLDSGVPDRFTGSGSGTDFTLKISRVEAEDLGVYYCWQGTHFPLTFGAGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 459 - protein, 214 aa, Artificial
  antibody sequence
DVVMTQTPSSFSVSLGDGVTITCKASEDIYIRLAWYQQKPGNAPRLLIFGATSLETGVPSRFSGSGSGKDYTLSITSLQTEDVATYYCQQYWRTPLTFGAGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 460 - protein, 219 aa, Artificial
  antibody sequence
DVVMTQTPLTLSVTIGQPASISCKSSQSLLDSDGKTYLNWLLQRPGQSPKRLIYLVSKLDSGVPDRFTGSGSGTDFTLKISRVEAEDLGVYYCWQGTHFPLTFGAGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 461 - protein, 219 aa, Artificial; identical to SEQ ID NO: 460
  antibody sequence

SEQ ID NO: 462 - protein, 219 aa, Artificial; identical to SEQ ID NO: 458
  antibody sequence

SEQ ID NO: 463 - protein, 219 aa, Artificial; identical to SEQ ID NO: 458
  antibody sequence

SEQ ID NO: 464 - protein, 445 aa, Artificial
  antibody sequence
EVQLQQSGPELKKPGETVKISCKTSGYTFTIYGMNWMKQAPGKGLKWMGWINTYTGEPTYADDFKGRFAFSLETSASTAYLQINNLKNEDTATYFCARCYYKYEDYAMDYWGQGTSVTVSSAKTTPPSVYPLAPGSAAQTNSMVTLGCLVKGYFPEPVTVTWNSGSLSSGVHTFPAVLESDLYTLSSSVTVPSSPRPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMNTNGSYFVYSKLNVQKSNWEAGNTFTCSVLHEGLHNHHTEKSLSHSPGK

SEQ ID NO: 465 - protein, 443 aa, Artificial
  antibody sequence
EVKLVESGGGLVKPGGSLKLSCAASGFTFSSYAMSWVRQTPEKRLEWVAAINGNGGSTYYPDTVKDRFTISRDNAKNTLYLQMSSLRSEDTALYYCARHRADGPWFTYWGQGTLVTVSAAKTTPPSVYPLAPGSAAQTNPMVTLGCLVKGYFPEPVTVTWNSGSLSSGVHTFPAVLESDLYTLSSSVTVPSSPRPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMNTNGSYFVYSKLNVQKSNWEAGNTFTCSVLHEGLHNHHTEKSLSHSPGK

SEQ ID NO: 466 - protein, 442 aa, Artificial
  antibody sequence
EVKLVESGGGLVKPGGSLKLSCAASGFTFSNYAMSWVRQTPEKRLEWVASISRRGSTYYPDSVKGRFTISRDNARNILYLQMSSLRSEDTALYYCATVYYDNPWFVYWGQGTLVTVSAAKTTPPSVYPLAPGSAAQTNSMVTLGCLVKGYFPEPVTVTWNSGSLSSGVHTFPAVLESDLYTLSSSVTVPSSPRPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMNTNGSYFVYSKLNVQKSNWEAGNTFTCSVLHEGLHNHHTEKSLSHSPGK

SEQ ID NO: 467 - protein, 445 aa, Artificial
  antibody sequence
QIQLVQSGPELKKPGETVKISCKTSGYTFTIYGMNWTKQAPGKGLKWMGWINTYTGEPTYADDFKGRFAFSLETSASTAYLQINNLKNEDTATYFCARCYYKYEDYAMDYWGQGTSVTVSSAKTTPPSVYPLAPGSAAQTNSMVTLGCLVKGYFPEPVTVTWNSGSLSSGVHTFPAVLESDLYTLSSSVTVPSSPRPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMNTNGSYFVYSKLNVQKSNWEAGNTFTCSVLHEGLHNHHTEKSLSHSPGK

SEQ ID NO: 468 - protein, 443 aa, Artificial
  antibody sequence
DVKLVESGGGLVKPGGSLKLSCAASGFTFSSYAMSWVRQTPEKRLEWVAAINGNGGSTYYPDTVKDRFTISRDNAKNTLYLQMSSLRSEDTALYYCARHRADGPWFTYWGQGTLVTVSAAKTTPPSVYPLAPGSAAQTNSMVTLGCLVKGYFPEPVTVTWNSGSLSSGVHTFPAVLESDLYTLSSSVTVPSSPRPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMNTNGSYFVYSKLNVQKSNWEAGNTFTCSVLHEGLHNHHTEKSLSHSPGK

SEQ ID NO: 469 - protein, 442 aa, Artificial; identical to SEQ ID NO: 466
  antibody sequence

SEQ ID NO: 470 - protein, 7 aa, Artificial
  antibody sequence
GFTFSNY

SEQ ID NO: 471 - protein, 5 aa, Artificial
  antibody sequence
SRRGS

SEQ ID NO: 472 - protein, 9 aa, Artificial
  antibody sequence
VYYDNPWFV

SEQ ID NO: 473 - protein, 7 aa, Artificial
  antibody sequence
STDIDDD

SEQ ID NO: 474 - protein, 7 aa, Artificial
  antibody sequence
SQSISDY

SEQ ID NO: 475 - protein, 13 aa, Artificial
  antibody sequence
SQSVLYSSNQKNY

SEQ ID NO: 476 - protein, 11 aa, Artificial
  antibody sequence
SKSVSTSGYSY

SEQ ID NO: 477 - protein, 11 aa, Artificial
  antibody sequence
SESVSFAGTSL

SEQ ID NO: 478 - protein, 3 aa, Artificial
  antibody sequence
EGN

SEQ ID NO: 479 - protein, 3 aa, Artificial
  antibody sequence
YDS

SEQ ID NO: 480 - protein, 3 aa, Artificial
  antibody sequence
WAS

SEQ ID NO: 481 - protein, 3 aa, Artificial
  antibody sequence
LVS

SEQ ID NO: 482 - protein, 3 aa, Artificial
  antibody sequence
YAS

SEQ ID NO: 483 - protein, 6 aa, Artificial
  antibody sequence
SDNMPY

SEQ ID NO: 484 - protein, 6 aa, Artificial
  antibody sequence
GHRFPF

SEQ ID NO: 485 - protein, 5 aa, Artificial
  antibody sequence
YLSSY

SEQ ID NO: 486 - protein, 5 aa, Artificial
  antibody sequence
IRELT

SEQ ID NO: 487 - protein, 6 aa, Artificial
  antibody sequence
GHSFPL

SEQ ID NO: 488 - protein, 107 aa, Artificial
  antibody sequence
ETTVTQSPASLSVATGEKVTIRCITSTDIDDDMSWYQQKPGEPPKLLISEGNTLRPGVPSRFSSSGCGTDFVFTIENTLSEDVADYYCLQSDNMPYTFGGGTKLEIK

SEQ ID NO: 489 - protein, 107 aa, Artificial
  antibody sequence
DIVMTQSPATLSVTPGDRVSLSCRASQSISDYLHWYQQKSHESPRLLIKYDSQSISGIPSRFSGSGSGSDFTLSINSVEPEDVGVYYCQNGHRFPFTFGGGTKLEIK

SEQ ID NO: 490 - protein, 112 aa, Artificial
  antibody sequence
NIMMTQSPSSLTVSAGEKVTMSCKSSQSVLYSSNQKNYLAWYQQKPGQSPKLLIYWASTRESGVPDRFAGSGSGTDFTLSISSVQAEDLAVYYCHQYLSSYTFGGGTKLEIK

SEQ ID NO: 491 - protein, 110 aa, Artificial
  antibody sequence
DIVLTQSPASLAVSLGQRATISYRASKSVSTSGYSYMHWNQQKPGQPPRLLIYLVSNLESGVPARFSGSGSGTDFTLNIHPVEEEDAATYYCQHIRELTRSEGGTKLEIK

SEQ ID NO: 492 - protein, 107 aa, Artificial
  antibody sequence
DIVMTQSPATLSVTPGDRVSLSCRASQSISDYLHWYQQKSHESPRLLIKYASQSISGIPSRFSGSGSGSDFTLSINSVEPEDVGVYYCQNGHSFPLTFGAGTKLELK

SEQ ID NO: 493 - protein, 110 aa, Artificial
  antibody sequence
DIVLTQSPASLAVSLGQRATISCQASESVSFAGTSLMHWYQQKPGQSPKLLIYWASTRESGVPDRFAGSGSGTDFTLSISSVQAEDLAVYYCHQYLSSYTFGGGTKLEIK

SEQ ID NO: 494 - protein, 118 aa, Artificial
  antibody sequence
EVMLVESGGGLVKPGGSLKLSCAASGFTFSNYAMSWVRQTPEKRLEWVASISRRGSTYYPDSGKGRFTISRDNARNIPYLQMSSLRSEDTALYYCATVYYDNPWFVYWGQGTLVTVSA

SEQ ID NO: 495 - protein, 118 aa, Artificial
  antibody sequence
EVMLVESGGGLVKPGGSLKLSCAASGFTFSNYAMSWVRQTPEKRLEWVASISRRGSTYYPDSVKGRFTISRDNARNILYLQMSSLRSEDTALYYCATVYYDNPWFVYWGQGTLVTVSA

SEQ ID NO: 496 - protein, 118 aa, Artificial; identical to SEQ ID NO: 454
  antibody sequence

SEQ ID NO: 497 - protein, 118 aa, Artificial; identical to SEQ ID NO: 454
  antibody sequence

SEQ ID NO: 498 - protein, 118 aa, Artificial; identical to SEQ ID NO: 454
  antibody sequence

SEQ ID NO: 499 - protein, 118 aa, Artificial; identical to SEQ ID NO: 495
  antibody sequence

SEQ ID NO: 500 - protein, 214 aa, Artificial
  antibody sequence
ETTVTQSPASLSVATGEKVTIRCITSTDIDDDMSWYQQKPGEPPKLLISEGNTLRPGVPSRFSSSGCGTDFVFTIENTLSEDVADYYCLQSDNMPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 501 - protein, 214 aa, Artificial
  antibody sequence
DIVMTQSPATLSVTPGDRVSLSCRASQSISDYLHWYQQKSHESPRLLIKYDSQSISGIPSRFSGSGSGSDFTLSINSVEPEDVGVYYCQNGHRFPFTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 502 - protein, 219 aa, Artificial
  antibody sequence
NIMMTQSPSSLTVSAGEKVTMSCKSSQSVLYSSNQKNYLAWYQQKPGQSPKLLIYWASTRESGVPDRFAGSGSGTDFTLSISSVQAEDLAVYYCHQYLSSYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 503 - protein, 217 aa, Artificial
  antibody sequence
DIVLTQSPASLAVSLGQRATISYRASKSVSTSGYSYMHWNQQKPGQPPRLLIYLVSNLESGVPARFSGSGSGTDFTLNIHPVEEEDAATYYCQHIRELTRSEGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 504 - protein, 214 aa, Artificial
  antibody sequence
DIVMTQSPATLSVTPGDRVSLSCRASQSISDYLHWYQQKSHESPRLLIKYASQSISGIPSRFSGSGSGSDFTLSINSVEPEDVGVYYCQNGHSFPLTFGAGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 505 - protein, 217 aa, Artificial
  antibody sequence
DIVLTQSPASLAVSLGQRATISCQASESVSFAGTSLMHWYQQKPGQSPKLLIYWASTRESGVPDRFAGSGSGTDFTLSISSVQAEDLAVYYCHQYLSSYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 506 - protein, 448 aa, Artificial
  antibody sequence
EVMLVESGGGLVKPGGSLKLSCAASGFTFSNYAMSWVRQTPEKRLEWVASISRRGSTYYPDSGKGRFTISRDNARNIPYLQMSSLRSEDTALYYCATVYYDNPWFVYWGQGTLVTVSAAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 507 - protein, 448 aa, Artificial
  antibody sequence
EVMLVESGGGLVKPGGSLKLSCAASGFTFSNYAMSWVRQTPEKRLEWVASISRRGSTYYPDSVKGRFTISRDNARNILYLQMSSLRSEDTALYYCATVYYDNPWFVYWGQGTLVTVSAAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 508 - protein, 448 aa, Artificial
  antibody sequence
EVKLVESGGGLVKPGGSLKLSCAASGFTFSNYAMSWVRQTPEKRLEWVASISRRGSTYYPDSVKGRFTISRDNARNILYLQMSSLRSEDTALYYCATVYYDNPWFVYWGQGTLVTVSAAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 509 - protein, 448 aa, Artificial; identical to SEQ ID NO: 508
  antibody sequence

SEQ ID NO: 510 - protein, 448 aa, Artificial; identical to SEQ ID NO: 508
  antibody sequence

SEQ ID NO: 511 - protein, 448 aa, Artificial; identical to SEQ ID NO: 507
  antibody sequence

SEQ ID NO: 512 - skipped

SEQ ID NO: 513 - protein, 7 aa, Artificial
  antibody sequence
GFTFSSF

SEQ ID NO: 514 - protein, 7 aa, Artificial
  antibody sequence
GYSFTGY

SEQ ID NO: 515 - protein, 7 aa, Artificial
  antibody sequence
GFTFTDF

SEQ ID NO: 516 - protein, 7 aa, Artificial
  antibody sequence
GFTFTNY

SEQ ID NO: 517 - protein, 7 aa, Artificial
  antibody sequence
GYSFTSN

SEQ ID NO: 518 - protein, 7 aa, Artificial
  antibody sequence
GFTFRNH

SEQ ID NO: 519 - protein, 7 aa, Artificial
  antibody sequence
GYTFTDY

SEQ ID NO: 520 - protein, 7 aa, Artificial
  antibody sequence
GFTFSSY

SEQ ID NO: 521 - protein, 7 aa, Artificial
  antibody sequence
GFSLTTY

SEQ ID NO: 522 - protein, 7 aa, Artificial
  antibody sequence
GFSLTSY

SEQ ID NO: 523 - protein, 7 aa, Artificial
  antibody sequence
GYKFSSY

SEQ ID NO: 524 - protein, 7 aa, Artificial
  antibody sequence
GFNIKDY

SEQ ID NO: 525 - protein, 7 aa, Artificial
  antibody sequence
GYTFTNY

SEQ ID NO: 526 - protein, 7 aa, Artificial
  antibody sequence
GFSITSY

SEQ ID NO: 527 - protein, 7 aa, Artificial
  antibody sequence
GLSLTSY

SEQ ID NO: 528 - protein, 7 aa, Artificial
  antibody sequence
GFNIKDS

SEQ ID NO: 529 - protein, 7 aa, Artificial
  antibody sequence
GFSFSNY

SEQ ID NO: 530 - protein, 5 aa, Artificial
  antibody sequence
SRTDN

SEQ ID NO: 531 - protein, 6 aa, Artificial
  antibody sequence
NPNNGG

SEQ ID NO: 532 - protein, 8 aa, Artificial
  antibody sequence
RNKANGYT

SEQ ID NO: 533 - protein, 6 aa, Artificial
  antibody sequence
NTYTGE

SEQ ID NO: 534 - protein, 6 aa, Artificial
  antibody sequence
HPSDSE

SEQ ID NO: 535 - protein, 6 aa, Artificial
  antibody sequence
NPYNGG

SEQ ID NO: 536 - protein, 6 aa, Artificial
  antibody sequence
NVNAGS

SEQ ID NO: 537 - protein, 6 aa, Artificial
  antibody sequence
YPNNGG

SEQ ID NO: 538 - protein, 6 aa, Artificial
  antibody sequence
NSNGGS

SEQ ID NO: 539 - protein, 5 aa, Artificial
  antibody sequence
WRGGT

SEQ ID NO: 540 - protein, 5 aa, Artificial
  antibody sequence
WSGGI

SEQ ID NO: 541 - protein, 6 aa, Artificial
  antibody sequence
LPGSGS

SEQ ID NO: 542 - protein, 6 aa, Artificial
  antibody sequence
DPENGN

SEQ ID NO: 543 - protein, 6 aa, Artificial
  antibody sequence
YPGGGY

SEQ ID NO: 544 - protein, 5 aa, Artificial
  antibody sequence
WSGGS

SEQ ID NO: 545 - protein, 5 aa, Artificial
  antibody sequence
WGDGS

SEQ ID NO: 546 - protein, 6 aa, Artificial
  antibody sequence
DPEDGE

SEQ ID NO: 547 - protein, 6 aa, Artificial
  antibody sequence
STSGSY

SEQ ID NO: 548 - protein, 6 aa, Artificial
  antibody sequence
NSGGSF

SEQ ID NO: 549 - protein, 9 aa, Artificial
  antibody sequence
ADYDGPWFA

SEQ ID NO: 550 - protein, 6 aa, Artificial
  antibody sequence
DDYSFA

SEQ ID NO: 551 - protein, 6 aa, Artificial
  antibody sequence
DVGDYD

SEQ ID NO: 552 - protein, 9 aa, Artificial
  antibody sequence
DYRDGDALD

SEQ ID NO: 553 - protein, 6 aa, Artificial
  antibody sequence
GDGGFA

SEQ ID NO: 554 - protein, 8 aa, Artificial
  antibody sequence
GYPRGWFA

SEQ ID NO: 555 - protein, 13 aa, Artificial
  antibody sequence
HRAYYNYDENAMD

SEQ ID NO: 556 - protein, 8 aa, Artificial
  antibody sequence
LTYYAKVD

SEQ ID NO: 557 - protein, 5 aa, Artificial
  antibody sequence
LYYGD

SEQ ID NO: 558 - protein, 2 aa, Artificial
  antibody sequence
TD

SEQ ID NO: 559 - protein, 10 aa, Artificial
  antibody sequence
TISTATDWFA

SEQ ID NO: 560 - protein, 7 aa, Artificial
  antibody sequence
YDGYAMD

SEQ ID NO: 561 - protein, 2 aa, Artificial
  antibody sequence
ND

SEQ ID NO: 562 - protein, 10 aa, Artificial
  antibody sequence
FYYDYDEGFD

SEQ ID NO: 563 - protein, 10 aa, Artificial
  antibody sequence
RGDYGSYAMD

SEQ ID NO: 564 - protein, 6 aa, Artificial
  antibody sequence
GGLILD

SEQ ID NO: 565 - protein, 9 aa, Artificial
  antibody sequence
DYREGDAMD

SEQ ID NO: 566 - protein, 8 aa, Artificial
  antibody sequence
HGDHDGFD

SEQ ID NO: 567 - protein, 8 aa, Artificial
  antibody sequence
HWDHPWFA

SEQ ID NO: 568 - protein, 4 aa, Artificial
  antibody sequence
SFGV

SEQ ID NO: 569 - protein, 7 aa, Artificial
  antibody sequence
SQDIGSS

SEQ ID NO: 570 - protein, 7 aa, Artificial
  antibody sequence
SQDIRSY

SEQ ID NO: 571 - protein, 7 aa, Artificial
  antibody sequence
SQEISGY

SEQ ID NO: 572 - protein, 12 aa, Artificial
  antibody sequence
SQIIVHSNGNTY

SEQ ID NO: 573 - protein, 12 aa, Artificial
  antibody sequence
SQSLANSYGNTY

SEQ ID NO: 574 - protein, 11 aa, Artificial
  antibody sequence
SESVDSYGNSF

SEQ ID NO: 575 - protein, 13 aa, Artificial
  antibody sequence
SQSLLNSRTRKNY

SEQ ID NO: 576 - protein, 12 aa, Artificial
  antibody sequence
SQSLLHSNGKTY

SEQ ID NO: 577 - protein, 7 aa, Artificial
  antibody sequence
SQDVSAA

SEQ ID NO: 578 - protein, 12 aa, Artificial
  antibody sequence
SQTIVHSSGNTY

SEQ ID NO: 579 - protein, 7 aa, Artificial
  antibody sequence
SQGISNY

SEQ ID NO: 580 - protein, 13 aa, Artificial
  antibody sequence
SQSLLYSSNQKNY

SEQ ID NO: 581 - protein, 7 aa, Artificial
  antibody sequence
SENIYSN

SEQ ID NO: 582 - protein, 7 aa, Artificial
  antibody sequence
SQDINSY

SEQ ID NO: 583 - protein, 12 aa, Artificial
  antibody sequence
SQTIVYSDGNTY

SEQ ID NO: 584 - protein, 12 aa, Artificial
  antibody sequence
SQTIVYSDGNTY

SEQ ID NO: 585 - protein, 12 aa, Artificial
  antibody sequence
SKSLLHSNGNTY

SEQ ID NO: 586 - protein, 7 aa, Artificial
  antibody sequence
SENIYSY

SEQ ID NO: 587 - protein, 7 aa, Artificial
  antibody sequence
SQDVSTA

SEQ ID NO: 588 - protein, 7 aa, Artificial
  antibody sequence
STDIDDD

SEQ ID NO: 589 - protein, 13 aa, Artificial
  antibody sequence
SQSLLNSGNQKNY

SEQ ID NO: 590 - protein, 7 aa, Artificial
  antibody sequence
SQDIGNS

SEQ ID NO: 591 - protein, 6 aa, Artificial
  antibody sequence
SSNVSY

SEQ ID NO: 592 - protein, 7 aa, Artificial
  antibody sequence
SQDIGSY

SEQ ID NO: 593 - protein, 7 aa, Artificial
  antibody sequence
SDHINNW

SEQ ID NO: 594 - protein, 6 aa, Artificial
  antibody sequence
SSSVSY

SEQ ID NO: 595 - protein, 7 aa, Artificial
  antibody sequence
SQSISDY

SEQ ID NO: 596 - protein, 8 aa, Artificial
  antibody sequence
SSSVSSSY

SEQ ID NO: 597 - protein, 12 aa, Artificial
  antibody sequence
SQSIVYSNGNTY

SEQ ID NO: 598 - protein, 13 aa, Artificial
  antibody sequence
SQSVLYNSNQRNY

SEQ ID NO: 599 - protein, 7 aa, Artificial
  antibody sequence
SQDVGTA

SEQ ID NO: 600 - protein, 7 aa, Artificial
  antibody sequence
SQDIDNY

SEQ ID NO: 601 - protein, 3 aa, Artificial
  antibody sequence
ATS

SEQ ID NO: 602 - protein, 3 aa, Artificial
  antibody sequence
YTS

SEQ ID NO: 603 - protein, 3 aa, Artificial
  antibody sequence
AAS

SEQ ID NO: 604 - protein, 3 aa, Artificial
  antibody sequence
KIS

SEQ ID NO: 605 - protein, 3 aa, Artificial
  antibody sequence
GIS

SEQ ID NO: 606 - protein, 3 aa, Artificial
  antibody sequence
RAS

SEQ ID NO: 607 - protein, 3 aa, Artificial
  antibody sequence
WAS

SEQ ID NO: 608 - protein, 3 aa, Artificial
  antibody sequence
KVS

SEQ ID NO: 609 - protein, 3 aa, Artificial
  antibody sequence
AAT

SEQ ID NO: 610 - protein, 3 aa, Artificial
  antibody sequence
RAN

SEQ ID NO: 611 - protein, 3 aa, Artificial
  antibody sequence
RMS

SEQ ID NO: 612 - protein, 3 aa, Artificial
  antibody sequence
NAK

SEQ ID NO: 613 - protein, 3 aa, Artificial
  antibody sequence
SAS

SEQ ID NO: 614 - protein, 3 aa, Artificial
  antibody sequence
EGN

SEQ ID NO: 615 - protein, 3 aa, Artificial
  antibody sequence
GAS

SEQ ID NO: 616 - protein, 3 aa, Artificial
  antibody sequence
DTS

SEQ ID NO: 617 - protein, 3 aa, Artificial
  antibody sequence
GAT

SEQ ID NO: 618 - protein, 3 aa, Artificial
  antibody sequence
YAS

SEQ ID NO: 619 - protein, 3 aa, Artificial
  antibody sequence
YDS

SEQ ID NO: 620 - protein, 3 aa, Artificial
  antibody sequence
STS

SEQ ID NO: 621 - protein, 3 aa, Artificial
  antibody sequence
LAS

SEQ ID NO: 622 - protein, 6 aa, Artificial
  antibody sequence
YASSPW

SEQ ID NO: 623 - protein, 6 aa, Artificial
  antibody sequence
GNTLPY

SEQ ID NO: 624 - protein, 6 aa, Artificial
  antibody sequence
YASYPR

SEQ ID NO: 625 - protein, 6 aa, Artificial
  antibody sequence
GSHVPW

SEQ ID NO: 626 - protein, 6 aa, Artificial
  antibody sequence
GTHQPP

SEQ ID NO: 627 - protein, 7 aa, Artificial
  antibody sequence
SNEDPPW

SEQ ID NO: 628 - protein, 5 aa, Artificial
  antibody sequence
SYNLW

SEQ ID NO: 629 - protein, 6 aa, Artificial
  antibody sequence
STHVPL

SEQ ID NO: 630 - protein, 6 aa, Artificial
  antibody sequence
HYSTPG

SEQ ID NO: 631 - protein, 6 aa, Artificial
  antibody sequence
GSHVPY

SEQ ID NO: 632 - protein, 6 aa, Artificial
  antibody sequence
YSKLPF

SEQ ID NO: 633 - protein, 6 aa, Artificial
  antibody sequence
YYSYPY

SEQ ID NO: 634 - protein, 6 aa, Artificial
  antibody sequence
FWGTPY

SEQ ID NO: 635 - protein, 6 aa, Artificial
  antibody sequence
YDEFPY

SEQ ID NO: 636 - protein, 6 aa, Artificial
  antibody sequence
YSKLPW

SEQ ID NO: 637 - protein, 6 aa, Artificial
  antibody sequence
HLEYPF

SEQ ID NO: 638 - protein, 6 aa, Artificial
  antibody sequence
YSKLPY

SEQ ID NO: 639 - protein, 6 aa, Artificial
  antibody sequence
HYGSPY

SEQ ID NO: 640 - protein, 6 aa, Artificial
  antibody sequence
HYSTPW

SEQ ID NO: 641 - protein, 6 aa, Artificial
  antibody sequence
SDNLPY

SEQ ID NO: 642 - protein, 6 aa, Artificial
  antibody sequence
DHSYPP

SEQ ID NO: 643 - protein, 6 aa, Artificial
  antibody sequence
FASSPL

SEQ ID NO: 644 - protein, 6 aa, Artificial
  antibody sequence
WSSNPR

SEQ ID NO: 645 - protein, 6 aa, Artificial
  antibody sequence
YATSPW

SEQ ID NO: 646 - protein, 6 aa, Artificial
  antibody sequence
YWSTPY

SEQ ID NO: 647 - protein, 7 aa, Artificial
  antibody sequence
WSSNPPI

SEQ ID NO: 648 - protein, 6 aa, Artificial
  antibody sequence
GHRFPF

SEQ ID NO: 649 - protein, 6 aa, Artificial
  antibody sequence
WSSYPP

SEQ ID NO: 650 - protein, 6 aa, Artificial
  antibody sequence
NNEDPY

SEQ ID NO: 651 - protein, 6 aa, Artificial
  antibody sequence
GTHQPY

SEQ ID NO: 652 - protein, 5 aa, Artificial
  antibody sequence
YLSSY

SEQ ID NO: 653 - protein, 6 aa, Artificial
  antibody sequence
YSSYPL

SEQ ID NO: 654 - protein, 6 aa, Artificial
  antibody sequence
GYTLPW

SEQ ID NO: 655 - protein, 107 aa, Artificial
  antibody sequence
DIQMTQSPSSLSASLGERVSLTCRASQDIGSSLNWLQQEPDGTIKRLIYATSSLDSGVPKRFSGSRSGSDYSLTISSLESEDFVDYYCLQYASSPWTFGGGTKLEIK

SEQ ID NO: 656 - protein, 107 aa, Artificial
  antibody sequence
DIQMTQTTSSLSASLGDRVTISCWASQDIRSYLNWYQQKPDGTVKLLIYYTSRLHSGVPSRFSGSGSGTDFSLTISNLEQEDIATYFCQQGNTLPYTFGGGTKLEIK

SEQ ID NO: 657 - protein, 107 aa, Artificial
  antibody sequence
DIQMTQSPSSLSASLGERVSLTCRASQEISGYLSWLQQKPDGTIKRLIYAASTLDSGVPKRFSGSRSGSDYSLTISSLESEDFADYYCLQYASYPRTFGGGTKLEIK

SEQ ID NO: 658 - protein, 112 aa, Artificial
  antibody sequence
DVLMTQTPLSLPVSLGDQASISCRSSQIIVHSNGNTYLDWYLQKPGQSPKLLIYKISNRFSGVPDRFSGSGSGTDFTLKISRVEAEDLGVYYCFQGSHVPWTFGGGTKLEIK

SEQ ID NO: 659 - protein, 112 aa, Artificial
  antibody sequence
DVVVTQTPLSLPVSFGDQVSISCRSSQSLANSYGNTYLSWYLHKPGQSPQLLIYGISNRFSGVPDRFSGSGSGTDFTLKISTIKPEGLGMYYCLQGTHQPPTFGAGTKLELK

SEQ ID NO: 660 - protein, 112 aa, Artificial
  antibody sequence
DIVLTQSPASLAVSLGQRATISCRASESVDSYGNSFMHWYQQKPGQPPKLLIYRASNLESGIPARFSGSGSRTDFTLTINPVEADDVATYYCQQSNEDPPWTFGGGTKLEIK

SEQ ID NO: 661 - protein, 112 aa, Artificial
  antibody sequence
DIVMSQSPSSLAVSAGEKVTMSCKSSQSLLNSRTRKNYLAWYQQKPGQSPKLLIYWASTRESGVPDRFTGSGSGTDFTLTISSVQAEDLAVYYCKQSYNLWTFGGGTKLEIK

SEQ ID NO: 662 - protein, 112 aa, Artificial
  antibody sequence
DVVMTQTPLSLPVSLGDQASISCRSSQSLLHSNGKTYLHWYLQKPGQSPKLLIYKVSNRFSGVPDRFSGSGSGTDFTLKISRVEAEDLGVYFCSQSTHVPLTFGAGTKLELK

SEQ ID NO: 663 - protein, 107 aa, Artificial
  antibody sequence
DIVMTQSHKFMSTSVGDRVSITCKASQDVSAAVAWYQQKPGQSPKLLIYWASTRHTGVPDRFTGSGSGTDYTLTISSVQAEDLALYYCQQHYSTPGTFGGGTKLEIK

SEQ ID NO: 664 - protein, 112 aa, Artificial
  antibody sequence
DVLMTQTPLSLPVSLGDQASISCRSSQTIVHSSGNTYLEWYLQRPGQSPKLLIYKVSNRFSGVPDRFSGSGSGTDFTLKISRVEAEDLGVYYCFQGSHVPYTFGGGTKLEIK

SEQ ID NO: 665 - protein, 107 aa, Artificial
  antibody sequence
DIQMTQTTSSLSASLGDRVTISCSASQGISNYLNWYQQKPDGTVKLLIYYTSSLHSGVPSRFSGSGSGTDYSLTISNLEPEDIATYYCQQYSKLPFTFGSGTKLEIK

SEQ ID NO: 666 - protein, 113 aa, Artificial
  antibody sequence
DIVMSQSPSSLAVSVGEKVTMSCKSSQSLLYSSNQKNYLAWYQQKPGQSPKLLIYWASTRESGVPDRLTGSGSGTDFTLTISSVKAEDLAVYYCQQYYSYPYTFGGGTKLEIK

SEQ ID NO: 667 - protein, 107 aa, Artificial
  antibody sequence
DIQMTQSPASLSVSVGETVTITCRASENIYSNLAWYQQKQGKSPQLLVYAATNLADGVPSRFSGSGSGTQYSLKINSLQSEDFGSYYCQHFWGTPYTFGGGTKLEIK

SEQ ID NO: 668 - protein, 107 aa, Artificial
  antibody sequence
DIKMTQSPSSMYASLGERVTITCKASQDINSYLSWFQQKPGKSPKTLIYRANRLVDGVPSRFSGSGSGQDYSLTISSLEYEDMGIYYCLQYDEFPYTFGGGTKLEIK

SEQ ID NO: 669 - protein, 107 aa, Artificial
  antibody sequence
DIQMTQTTSSLSASLGDRVTISCSASQGISNYLNWYQQKPDGTVKLLIHYTSSLHSGVPSRFSGSGSGTDYSLTISNLEPEDIATYYCQQYSKLPWTFGGGTKLEIK

SEQ ID NO: 670 - protein, 112 aa, Artificial
  antibody sequence
DVLMTQTPLSLPVSLGDQASISCRSSQTIVYSDGNTYLEWYLQKPGQSPKLLIYKVSNRFSGVPDRVSGSGSGTDFTLKISRVEAEDLGVYYCFQGSHVPYTFGGGTKLEIK

SEQ ID NO: 671 - protein, 112 aa, Artificial; identical to SEQ ID NO: 670
  antibody sequence

SEQ ID NO: 672 - protein, 112 aa, Artificial
  antibody sequence
DIVMTQAAPSVPVTPGESVSISCRSSKSLLHSNGNTYLYWFLQRPGQSPQLLIYRMSNLASGVPDRFSGSGSGTAFTLRISRVEAEDVGVYYCMQHLEYPFTFGSGTKLEIK

SEQ ID NO: 673 - protein, 107 aa, Artificial
  antibody sequence
DIQMTQTTSSLSASLGDRVTISCSASQGISNYLNWYQQKPDGTVKLLIYYTSSLHSGVPSRFSGSGSGTDYSLTISNLEPEDIATYYCQQYSKLPYTFGGGTKLEIK

SEQ ID NO: 674 - protein, 107 aa, Artificial
  antibody sequence
DIQMTQSPASLSASVGETVTIICRASENIYSYLAWYQQKQGKSPQLLVYNAKTLVEGVPSRFSGSGSGTQFSLKINSLQPEDFGSYYCQHHYGSPYTFGGGTKLEIK

SEQ ID NO: 675 - protein, 107 aa, Artificial
  antibody sequence
DIVMTQSHKFMSTSVGDRVSITCKASQDVSTAVAWYQQKPGQSPKLLIYSASYRYTGVPDRFTGSGSGTDFTFTISSVQAEDLAVYYCQQHYSTPWTFGGGTKLEIK

SEQ ID NO: 676 - protein, 107 aa, Artificial
  antibody sequence
ETTVTQSPASLSMAIGEKVTIRCITSTDIDDDMNWYQQKPGEPPKLLISEGNTLRPGVPSRFSSSGYGTDFVFTIENMLSEDVADYYCLQSDNLPYTFGGGTKLEIK

SEQ ID NO: 677 - protein, 113 aa, Artificial
  antibody sequence
DIVMTQSPSSLSVSAGEKVTMSCKSSQSLLNSGNQKNYLAWYQQKPGQPPKLLIYGASTRESGVPDRFTGSGSGTDFTLTISSVQAEDLAVYYCQNDHSYPPTFGGGTKLEIK

SEQ ID NO: 678 - protein, 107 aa, Artificial
  antibody sequence
DIQMTQSPSSLSASLGERVSLTCRASQDIGNSLNWLQQKPDGTIKRLIYATSNLDSGVPKRFSGSRSGSDYSLTISSLESEDFVNYYCLQFASSPLTFGTGTKLEIK

SEQ ID NO: 679 - protein, 107 aa, Artificial; identical to SEQ ID NO: 667
  antibody sequence

SEQ ID NO: 680 - protein, 106 aa, Artificial
  antibody sequence
QIVLTQSPAIMSASPGEKVTMTCSASSNVSYMHWFQQKSGTSPKRWIYDTSKLASGVPARFSGSGSGTSYSLTVSSMEAEDAATYYCQQWSSNPRTFGGGTKLEIK

SEQ ID NO: 681 - protein, 107 aa, Artificial
  antibody sequence
DIQMTQSPSSLSASLGERVSLTCRASQDIGSYLNWLQQEPDGTIKRLIYATSSLDSGVPKRFSGSRSGADYSLTISSLESEDFVDYYCLQYATSPWTFGGGTKLEIK

SEQ ID NO: 682 - protein, 107 aa, Artificial
  antibody sequence
DIQMTQSSSYLSVSLGGRVTITCKASDHINNWLAWYQQKPGNAPRLLISGATSLETGVPSRFSGSGSGKDYTLSITSLQTEDVATYYCQQYWSTPYTFGGGTKLEIK

SEQ ID NO: 683 - protein, 105 aa, Artificial
  antibody sequence
QIVLTQSPALMSASPGEKVTMTCSASSSVSYMYWYQQKPRSSPKLKYASNLASGVPARFSGSGSGTSYSLTISSMEAEDAATYYCQQWSSNPPITFGAGTKLELK

SEQ ID NO: 684 - protein, 107 aa, Artificial; identical to SEQ ID NO: 489
  antibody sequence

SEQ ID NO: 685 - protein, 108 aa, Artificial
  antibody sequence
QIVLTQSPAIMSASPGEKVTLTCSASSSVSSSYLFWYQQKPGSSPKLWIYSTSNLASGVPVRFSGSGFGTSYSLTISRMEAEDAASYFCHQWSSYPPTFGAGTKLELK

SEQ ID NO: 686 - protein, 111 aa, Artificial
  antibody sequence
DIVLTQSPASLAVSLGQRATISCRASESVDSYGNSFMHWYQQKPGQPPKLLIYLASNLESGVPARFSGSGSRTDFTLTIDPVEADDAATYYCQQNNEDPYTFGGGTKLEIK

SEQ ID NO: 687 - protein, 112 aa, Artificial
  antibody sequence
DVLMTQTPLSLPVSLGDQASISCRSSQSIVYSNGNTYLDWYLQKPGQPPKLLIYKVSNRFSGVPDRFSGSGSGTDFILKISRVEAEDLGVYYCFQGSHVPWTFGGGTKLEIK

SEQ ID NO: 688 - protein, 112 aa, Artificial
  antibody sequence
DVVVTQTPLSLPVSFGDQVSISCRSSQSLANSYGNTYLSWYLHKPGQSPQLLIYGISNRFSGVPDRFSGSGSGTDFTLKISTIKPEDLGMYYCLQGTHQPYTFGGGTKLEIK

SEQ ID NO: 689 - protein, 112 aa, Artificial
  antibody sequence
DIVMSQSPSSLAVSVGEKVTMSCKSSQSVLYNSNQRNYLAWYQQKPGQSPKLLIYWASTRESGVPDRSTGSGSGTDFTLTISSVQAEDLAVYYCHQYLSSYTFGGGTKLEIK

SEQ ID NO: 690 - protein, 107 aa, Artificial
  antibody sequence
DIVMTQSHKFMSTSVGDRVSITCKASQDVGTAVAWYQQKPGQSPKLLIYWASTRHTGVPDRFTGSGSGTDFTLTISNVQSEDLADYFCQQYSSYPLTFGAGTKLELK

SEQ ID NO: 691 - protein, 112 aa, Artificial; identical to SEQ ID NO: 660
  antibody sequence

SEQ ID NO: 692 - protein, 112 aa, Artificial; identical to SEQ ID NO: 660
  antibody sequence

SEQ ID NO: 693 - protein, 107 aa, Artificial
  antibody sequence
DIQMTQTTSSLSASLGDRVTISCRASQDIDNYLNWYQQKPDGTVKLLISYTSRLHSGVPSRFSGSGSGTDYSLTISNLEQEDFATYFCQQGYTLPWTFGGGTKLEIK

SEQ ID NO: 694 - protein, 118 aa, Artificial
  antibody sequence
EVKLVESGGDLVKPGGSLKLSCAASGFTFSSFAMSWVRQTPEKRLEWVASISRTDNTYYPDSMKGQFTISRDNARNILYLQMSSLRSENTAIYYCARADYDGPWFAYWGQGTLVTVSA

SEQ ID NO: 695 - protein, 116 aa, Artificial
  antibody sequence
EVQLQQSGPDLVKPGTSVKMSCKASGYSFTGYYMHWVKQSHGKSLEWIGRVNPNNGGTSYNQKFKGKAILTVDKSSSTAYMELRSLTSEDSAVYYCARDDYSFAYWGQGTLVTVSA

SEQ ID NO: 696 - protein, 118 aa, Artificial
  antibody sequence
EVKLVESGGGLVQPGGSLRLSCATSGFTFTDFYMSWVRQPPGKALEWLAFIRNKANGYTTEYSSSVRGRFTISRDNSQSILYLQMNTLRAEDSGTYYCARDVGDYDYWGQGSTLTVSS

SEQ ID NO: 697 - protein, 119 aa, Artificial
  antibody sequence
QIQLVQSGPELKKPGETVKISCKASGFTFTNYGMNWVKQAPGKDLKWMGWINTYTGEPTYADDFKGRFAFSLETSASTAYLQINNLKDEDTASYFCARDYRDGDALDYWGQGTSVTVSS

SEQ ID NO: 698 - protein, 116 aa, Artificial
  antibody sequence
QVQLQQPGAELVRPGASVKLSCKASGYSFTSNWMNWMKQRPGQGLEWIGMIHPSDSESRLNQKFKDKATLTVDKSSSTAYMQLSSPTSEDSAVYYCARGDGGFAYWGQGTLVTVSA

SEQ ID NO: 699 - protein, 118 aa, Artificial
  antibody sequence
EVKLQQSGPELVKPGASMKISCKASGYSFTGYTMNWAKQSHGKNLEWIGLINPYNGGTSYNQKFKGKATLTVDKSSSTAYMELLSLTSEDSAVYYCARGYPRGWFAYWGQGTLVTVSA

SEQ ID NO: 700 - protein, 123 aa, Artificial
  antibody sequence
DVKLVESGGGLVKPGGSLKLSCAASGFTFRNHAMSWVRQTPEKRLEWVAAINVNAGSTYYPDTVKDRFTISRDNAKNTLYLQMSSLRSEDTALYYCARHRAYYNYDENAMDYWGQGTSVTVSS

SEQ ID NO: 701 - protein, 118 aa, Artificial
  antibody sequence
EVQLQQSGPELVKPGDSVKMSCKASGYTFTDYYIDWMKQSHGKSLEWIGYIYPNNGGTSYNQNFKDKATLTVDKSSSTAYMELHSLTSEDSAVYYCARLTYYAKVDSWGQGTSVTVSS

SEQ ID NO: 702 - protein, 115 aa, Artificial
  antibody sequence
DVKLVESGGGLVEWEGVLKLSCAASGFTFSSYAMSWVRQTPEKRLEWVAAINSNGGSTYYPDTVKDRFTISRDNAKNTLYLQMSSLRSEDTALYYCARLYYGDYWGQGTTLTVSS

SEQ ID NO: 703 - protein, 111 aa, Artificial
  antibody sequence
QVQLKQSGPSLVQPSQSLSITCTVSGFSLTTYGLHWIRQSPGKGLEWLGVIWRGGTTDYNAAFMSRLTITKDNSKSQVFFKMNSLQADDTAIYYCARTDIWGAGTTVTVSS

SEQ ID NO: 704 - protein, 111 aa, Artificial; identical to SEQ ID NO: 703
  antibody sequence

SEQ ID NO: 705 - protein, 111 aa, Artificial; identical to SEQ ID NO: 703
  antibody sequence

SEQ ID NO: 706 - protein, 111 aa, Artificial
  antibody sequence
QVQLKQSGPGLVQPSQSLPITCTVSGFSLTTYGLHWIRQSPGKGLEWLGVIWRGGTTDYNAAFMSRLTITKDNSKSQVFFKMNSLQADDTAIYYCARTDIWGAGTTVTVSS

SEQ ID NO: 707 - protein, 111 aa, Artificial
  antibody sequence
QVQLKQSGPGLVQPSQSLSITCTVSGFSLTTYGLHWIRQSPGKGLEWLGVIWRGGTTDYNAAFMSRLTITKDNSKSQVFFKMNSLQADDTAIYYCARTDIWGAGTTVTVSS

SEQ ID NO: 708 - protein, 111 aa, Artificial; identical to SEQ ID NO: 703
  antibody sequence

SEQ ID NO: 709 - protein, 111 aa, Artificial
  antibody sequence
QVQLKQSGPGLVQPSQSLSITCTVSGFSLTSYGVHWVRQPPGKGLEWLGVIWSGGITDYNAAFISRLSISKDNSKSQVFFKMNSLQADDTAIYYCARTDLWGQGTLVTVSA

SEQ ID NO: 710 - protein, 120 aa, Artificial
  antibody sequence
QVQLQQSGAELMNPGASVKISCKSTGYKFSSYWIEWVKQRPGHGLEWMGEILPGSGSTNHNEKFKGKAIFTADASSNTAYMELSSLTSEDSAVYYCARTISTATDWFAYWGQGTLVTVSA

SEQ ID NO: 711 - protein, 120 aa, Artificial; identical to SEQ ID NO: 710
  antibody sequence

SEQ ID NO: 712 - protein, 120 aa, Artificial
  antibody sequence
QVQLQQSGAELMKPGASVKMSCKATGYKFSSYWIEWVKQRPGHGLEWMGEILPGSGSTNHNEKFKGKAIFTADASSNTAYMELSSLTSEDSAVYYCARTISTATDWFAYWGQGTLVTVSA

SEQ ID NO: 713 - protein, 120 aa, Artificial
  antibody sequence
QVQLQQSGAELMKPGASVKMSCKATGYKFSSYWIEWVKQRPGHGLEWMGEILPGSGSTNHNEKFTGRAIFTADASSNTAYMELSSLTSEDSAVYYCARTISTATDWFAYWGQGTLVTVSA

SEQ ID NO: 714 - protein, 120 aa, Artificial; identical to SEQ ID NO: 712
  antibody sequence

SEQ ID NO: 715 - protein, 120 aa, Artificial
  antibody sequence
QVQLQQSGAELMKPGASVKMPCKATGYKFSSYWIEWVKQRPGHGLEWMGEILPGSGSTNHNEKFKGKAIFTADASSNTAYMELSSLTSEDSAVYYCARTISTATDWFAYWGQGTLVTVSA

SEQ ID NO: 716 - protein, 117 aa, Artificial
  antibody sequence
EVQLQQSGAELVRPGALVKLSCKASGFNIKDYYMHWVKQRPEQGLEWIGWIDPENGNTIYDPKFQGKASITADTSSNTAYLQLSSLTSEDTAVYYCARYDGYAMDYWGQGTSVTVSS

SEQ ID NO: 717 - protein, 112 aa, Artificial
  antibody sequence
QVQLQQSGAELVRPGTSVKMSCKAAGYTFTNYWIGWVKQRPGHGLEWIGDIYPGGGYTNYNEKFKDKTTLTADTSSNTAYMQLSSLTSEDSAIYYCASNDCWGQGTTLTVSS

SEQ ID NO: 718 - protein, 119 aa, Artificial
  antibody sequence
QVQLKQSGPGLVQPSQSLSITCTVSGFSITSYGVHWIRQSPGKGLEWLGVIWSGGSTDYNAAFISRLSISEDNSKSQVFFKMNSLQANDTAIYYCATFYYDYDEGFDYWGQGTTLTVSS

SEQ ID NO: 719 - protein, 119 aa, Artificial
  antibody sequence
QVQLKQSGPGLVQPSQSLSITCTVSGFSITSYGVHWIRQSPGKGLEWLGVIWSGGSTDYNAAFISRLSISKDNSKSQVFFKMNSLQANDTAIYYCATFYYDYDEGFDYWGQGTTLTVSS

SEQ ID NO: 720 - protein, 119 aa, Artificial; identical to SEQ ID NO: 719
  antibody sequence

SEQ ID NO: 721 - protein, 119 aa, Artificial; identical to SEQ ID NO: 719
  antibody sequence

SEQ ID NO: 722 - protein, 119 aa, Artificial; identical to SEQ ID NO: 719
  antibody sequence

SEQ ID NO: 723 - protein, 119 aa, Artificial; identical to SEQ ID NO: 719
  antibody sequence

SEQ ID NO: 724 - protein, 119 aa, Artificial
  antibody sequence
QVQLKESGPGLVAPSQSLSITCTVSGLSLTSYGLSWVRQPPGKGLEWLGVIWGDGSTNYHSALISRLSISKDNSKSQVFLKLNSLQSDDTATYYCATRGDYGSYAMDYWGQGTSVTVSS

SEQ ID NO: 725 - protein, 116 aa, Artificial
  antibody sequence
EVQLQQSGAELVRPGASVKLSCTASGFNIKDSLIHWVKQRPEQGLEWIGWIDPEDGETKYAPKFQDKAALTTDTSSNTAYLHLNSLTSEDTAIYYCGRGGLILDYWGQGTTLTVSS

SEQ ID NO: 726 - protein, 119 aa, Artificial
  antibody sequence
QIQLVQSGPELKKPGETVKISCRSSGYTFTNYGLNWVKQAPGKDLKWMGWLNTYTGEPTYADDFKGRFAFSLETSAGTAYLQINNLKNEDTATYFCSRDYREGDAMDYWSQGTSVTVSS

SEQ ID NO: 727 - protein, 118 aa, Artificial
  antibody sequence
EVQLVESGGGLVKPGGSLKLSCAASGFTFSSYAMSWVRQTPEKRLEWVATISTSGSYTYYRDSVKGRLTISRDNAKNTLYLQMTSLRSEDTAMYYCTRHGDHDGFDYWGQGTTLTVSS

SEQ ID NO: 728 - protein, 118 aa, Artificial
  antibody sequence
EVQLVESGGGLVKPGGSLKLSCVASGFSFSNYAMSWVRQTPERRLEWVATINSGGSFSFFPDSVKGRFTISRDSAKNTLYLQMSSLRSDDTAMYYCTRHWDHPWFAYWGQGTLVTVSA

SEQ ID NO: 729 - protein, 118 aa, Artificial; identical to SEQ ID NO: 728
  antibody sequence

SEQ ID NO: 730 - protein, 118 aa, Artificial; identical to SEQ ID NO: 728
  antibody sequence

SEQ ID NO: 731 - protein, 114 aa, Artificial
  antibody sequence
EVQLQQSGAELVRPGASVKLSCTTSGFNIKDSLIYWVKQRPEQGLEWIGWIDPEDGETKFAPRFQDKATITSDTSSNTAYLRLSSLTSKDTAIYYCTRSFGVCWGQGTLVTVSA

SEQ ID NO: 732 - protein, 114 aa, Artificial; identical to SEQ ID NO: 202
  antibody sequence

SEQ ID NO: 733 - protein, 214 aa, Artificial
  antibody sequence
DIQMTQSPSSLSASLGERVSLTCRASQDIGSSLNWLQQEPDGTIKRLIYATSSLDSGVPKRFSGSRSGSDYSLTISSLESEDFVDYYCLQYASSPWTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 734 - protein, 214 aa, Artificial
  antibody sequence
DIQMTQTTSSLSASLGDRVTISCWASQDIRSYLNWYQQKPDGTVKLLIYYTSRLHSGVPSRFSGSGSGTDFSLTISNLEQEDIATYFCQQGNTLPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 735 - protein, 214 aa, Artificial
  antibody sequence
DIQMTQSPSSLSASLGERVSLTCRASQEISGYLSWLQQKPDGTIKRLIYAASTLDSGVPKRFSGSRSGSDYSLTISSLESEDFADYYCLQYASYPRTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 736 - protein, 219 aa, Artificial
  antibody sequence
DVLMTQTPLSLPVSLGDQASISCRSSQIIVHSNGNTYLDWYLQKPGQSPKLLIYKISNRFSGVPDRFSGSGSGTDFTLKISRVEAEDLGVYYCFQGSHVPWTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 737 - protein, 219 aa, Artificial
  antibody sequence
DVVVTQTPLSLPVSFGDQVSISCRSSQSLANSYGNTYLSWYLHKPGQSPQLLIYGISNRFSGVPDRFSGSGSGTDFTLKISTIKPEGLGMYYCLQGTHQPPTFGAGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 738 - protein, 219 aa, Artificial
  antibody sequence
DIVLTQSPASLAVSLGQRATISCRASESVDSYGNSFMHWYQQKPGQPPKLLIYRASNLESGIPARFSGSGSRTDFTLTINPVEADDVATYYCQQSNEDPPWTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 739 - protein, 219 aa, Artificial
  antibody sequence
DIVMSQSPSSLAVSAGEKVTMSCKSSQSLLNSRTRKNYLAWYQQKPGQSPKLLIYWASTRESGVPDRFTGSGSGTDFTLTISSVQAEDLAVYYCKQSYNLWTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 740 - protein, 219 aa, Artificial
  antibody sequence
DVVMTQTPLSLPVSLGDQASISCRSSQSLLHSNGKTYLHWYLQKPGQSPKLLIYKVSNRFSGVPDRFSGSGSGTDFTLKISRVEAEDLGVYFCSQSTHVPLTFGAGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 741 - protein, 214 aa, Artificial
  antibody sequence
DIVMTQSHKFMSTSVGDRVSITCKASQDVSAAVAWYQQKPGQSPKLLIYWASTRHTGVPDRFTGSGSGTDYTLTISSVQAEDLALYYCQQHYSTPGTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 742 - protein, 219 aa, Artificial
  antibody sequence
DVLMTQTPLSLPVSLGDQASISCRSSQTIVHSSGNTYLEWYLQRPGQSPKLLIYKVSNRFSGVPDRFSGSGSGTDFTLKISRVEAEDLGVYYCFQGSHVPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 743 - protein, 214 aa, Artificial
  antibody sequence
DIQMTQTTSSLSASLGDRVTISCSASQGISNYLNWYQQKPDGTVKLLIYYTSSLHSGVPSRFSGSGSGTDYSLTISNLEPEDIATYYCQQYSKLPFTFGSGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 744 - protein, 220 aa, Artificial
  antibody sequence
DIVMSQSPSSLAVSVGEKVTMSCKSSQSLLYSSNQKNYLAWYQQKPGQSPKLLIYWASTRESGVPDRLTGSGSGTDFTLTISSVKAEDLAVYYCQQYYSYPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 745 - protein, 214 aa, Artificial
  antibody sequence
DIQMTQSPASLSVSVGETVTITCRASENIYSNLAWYQQKQGKSPQLLVYAATNLADGVPSRFSGSGSGTQYSLKINSLQSEDFGSYYCQHFWGTPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 746 - protein, 214 aa, Artificial
  antibody sequence
DIKMTQSPSSMYASLGERVTITCKASQDINSYLSWFQQKPGKSPKTLIYRANRLVDGVPSRFSGSGSGQDYSLTISSLEYEDMGIYYCLQYDEFPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 747 - protein, 214 aa, Artificial
  antibody sequence
DIQMTQTTSSLSASLGDRVTISCSASQGISNYLNWYQQKPDGTVKLLIHYTSSLHSGVPSRFSGSGSGTDYSLTISNLEPEDIATYYCQQYSKLPWTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 748 - protein, 219 aa, Artificial
  antibody sequence
DVLMTQTPLSLPVSLGDQASISCRSSQTIVYSDGNTYLEWYLQKPGQSPKLLIYKVSNRFSGVPDRVSGSGSGTDFTLKISRVEAEDLGVYYCFQGSHVPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 749 - protein, 219 aa, Artificial; identical to SEQ ID NO: 748
  antibody sequence

SEQ ID NO: 750 - protein, 219 aa, Artificial
  antibody sequence
DIVMTQAAPSVPVTPGESVSISCRSSKSLLHSNGNTYLYWFLQRPGQSPQLLIYRMSNLASGVPDRFSGSGSGTAFTLRISRVEAEDVGVYYCMQHLEYPFTFGSGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 751 - protein, 214 aa, Artificial
  antibody sequence
DIQMTQTTSSLSASLGDRVTISCSASQGISNYLNWYQQKPDGTVKLLIYYTSSLHSGVPSRFSGSGSGTDYSLTISNLEPEDIATYYCQQYSKLPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 752 - protein, 214 aa, Artificial
  antibody sequence
DIQMTQSPASLSASVGETVTIICRASENIYSYLAWYQQKQGKSPQLLVYNAKTLVEGVPSRFSGSGSGTQFSLKINSLQPEDFGSYYCQHHYGSPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 753 - protein, 214 aa, Artificial
  antibody sequence
DIVMTQSHKFMSTSVGDRVSITCKASQDVSTAVAWYQQKPGQSPKLLIYSASYRYTGVPDRFTGSGSGTDFTFTISSVQAEDLAVYYCQQHYSTPWTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 754 - protein, 214 aa, Artificial
  antibody sequence
ETTVTQSPASLSMAIGEKVTIRCITSTDIDDDMNWYQQKPGEPPKLLISEGNTLRPGVPSRFSSSGYGTDFVFTIENMLSEDVADYYCLQSDNLPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 755 - protein, 220 aa, Artificial
  antibody sequence
DIVMTQSPSSLSVSAGEKVTMSCKSSQSLLNSGNQKNYLAWYQQKPGQPPKLLIYGASTRESGVPDRFTGSGSGTDFTLTISSVQAEDLAVYYCQNDHSYPPTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 756 - protein, 214 aa, Artificial
  antibody sequence
DIQMTQSPSSLSASLGERVSLTCRASQDIGNSLNWLQQKPDGTIKRLIYATSNLDSGVPKRFSGSRSGSDYSLTISSLESEDFVNYYCLQFASSPLTFGTGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 757 - protein, 214 aa, Artificial; identical to SEQ ID NO: 745
  antibody sequence

SEQ ID NO: 758 - protein, 213 aa, Artificial
  antibody sequence
QIVLTQSPAIMSASPGEKVTMTCSASSNVSYMHWFQQKSGTSPKRWIYDTSKLASGVPARFSGSGSGTSYSLTVSSMEAEDAATYYCQQWSSNPRTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 759 - protein, 214 aa, Artificial
  antibody sequence
DIQMTQSPSSLSASLGERVSLTCRASQDIGSYLNWLQQEPDGTIKRLIYATSSLDSGVPKRFSGSRSGADYSLTISSLESEDFVDYYCLQYATSPWTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 760 - protein, 214 aa, Artificial
  antibody sequence
DIQMTQSSSYLSVSLGGRVTITCKASDHINNWLAWYQQKPGNAPRLLISGATSLETGVPSRFSGSGSGKDYTLSITSLQTEDVATYYCQQYWSTPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 761 - protein, 212 aa, Artificial
  antibody sequence
QIVLTQSPALMSASPGEKVTMTCSASSSVSYMYWYQQKPRSSPKLKYASNLASGVPARFSGSGSGTSYSLTISSMEAEDAATYYCQQWSSNPPITFGAGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 762 - protein, 214 aa, Artificial; identical to SEQ ID NO: 501
  antibody sequence

SEQ ID NO: 763 - protein, 215 aa, Artificial
  antibody sequence
QIVLTQSPAIMSASPGEKVTLTCSASSSVSSSYLFWYQQKPGSSPKLWIYSTSNLASGVPVRFSGSGFGTSYSLTISRMEAEDAASYFCHQWSSYPPTFGAGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 764 - protein, 218 aa, Artificial
  antibody sequence
DIVLTQSPASLAVSLGQRATISCRASESVDSYGNSFMHWYQQKPGQPPKLLIYLASNLESGVPARFSGSGSRTDFTLTIDPVEADDAATYYCQQNNEDPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 765 - protein, 219 aa, Artificial
  antibody sequence
DVLMTQTPLSLPVSLGDQASISCRSSQSIVYSNGNTYLDWYLQKPGQPPKLLIYKVSNRFSGVPDRFSGSGSGTDFILKISRVEAEDLGVYYCFQGSHVPWTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 766 - protein, 219 aa, Artificial
  antibody sequence
DVVVTQTPLSLPVSFGDQVSISCRSSQSLANSYGNTYLSWYLHKPGQSPQLLIYGISNRFSGVPDRFSGSGSGTDFTLKISTIKPEDLGMYYCLQGTHQPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 767 - protein, 219 aa, Artificial
  antibody sequence
DIVMSQSPSSLAVSVGEKVTMSCKSSQSVLYNSNQRNYLAWYQQKPGQSPKLLIYWASTRESGVPDRSTGSGSGTDFTLTISSVQAEDLAVYYCHQYLSSYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 768 - protein, 214 aa, Artificial
  antibody sequence
DIVMTQSHKFMSTSVGDRVSITCKASQDVGTAVAWYQQKPGQSPKLLIYWASTRHTGVPDRFTGSGSGTDFTLTISNVQSEDLADYFCQQYSSYPLTFGAGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 769 - protein, 219 aa, Artificial; identical to SEQ ID NO: 738
  antibody sequence

SEQ ID NO: 770 - protein, 219 aa, Artificial; identical to SEQ ID NO: 738
  antibody sequence

SEQ ID NO: 771 - protein, 214 aa, Artificial
  antibody sequence
DIQMTQTTSSLSASLGDRVTISCRASQDIDNYLNWYQQKPDGTVKLLISYTSRLHSGVPSRFSGSGSGTDYSLTISNLEQEDFATYFCQQGYTLPWTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 772 - protein, 448 aa, Artificial
  antibody sequence
EVKLVESGGDLVKPGGSLKLSCAASGFTFSSFAMSWVRQTPEKRLEWVASISRTDNTYYPDSMKGQFTISRDNARNILYLQMSSLRSENTAIYYCARADYDGPWFAYWGQGTLVTVSAAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 773 - protein, 446 aa, Artificial
  antibody sequence
EVQLQQSGPDLVKPGTSVKMSCKASGYSFTGYYMHWVKQSHGKSLEWIGRVNPNNGGTSYNQKFKGKAILTVDKSSSTAYMELRSLTSEDSAVYYCARDDYSFAYWGQGTLVTVSAAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 774 - protein, 448 aa, Artificial
  antibody sequence
EVKLVESGGGLVQPGGSLRLSCATSGFTFTDFYMSWVRQPPGKALEWLAFIRNKANGYTTEYSSSVRGRFTISRDNSQSILYLQMNTLRAEDSGTYYCARDVGDYDYWGQGSTLTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 775 - protein, 449 aa, Artificial
  antibody sequence
QIQLVQSGPELKKPGETVKISCKASGFTFTNYGMNWVKQAPGKDLKWMGWINTYTGEPTYADDFKGRFAFSLETSASTAYLQINNLKDEDTASYFCARDYRDGDALDYWGQGTSVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 776 - protein, 446 aa, Artificial
  antibody sequence
QVQLQQPGAELVRPGASVKLSCKASGYSFTSNWMNWMKQRPGQGLEWIGMIHPSDSESRLNQKFKDKATLTVDKSSSTAYMQLSSPTSEDSAVYYCARGDGGFAYWGQGTLVTVSAAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 777 - protein, 448 aa, Artificial
  antibody sequence
EVKLQQSGPELVKPGASMKISCKASGYSFTGYTMNWAKQSHGKNLEWIGLINPYNGGTSYNQKFKGKATLTVDKSSSTAYMELLSLTSEDSAVYYCARGYPRGWFAYWGQGTLVTVSAAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 778 - protein, 453 aa, Artificial
  antibody sequence
DVKLVESGGGLVKPGGSLKLSCAASGFTFRNHAMSWVRQTPEKRLEWVAAINVNAGSTYYPDTVKDRFTISRDNAKNTLYLQMSSLRSEDTALYYCARHRAYYNYDENAMDYWGQGTSVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 779 - protein, 448 aa, Artificial
  antibody sequence
EVQLQQSGPELVKPGDSVKMSCKASGYTFTDYYIDWMKQSHGKSLEWIGYIYPNNGGTSYNQNFKDKATLTVDKSSSTAYMELHSLTSEDSAVYYCARLTYYAKVDSWGQGTSVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 780 - protein, 445 aa, Artificial
  antibody sequence
DVKLVESGGGLVEWEGVLKLSCAASGFTFSSYAMSWVRQTPEKRLEWVAAINSNGGSTYYPDTVKDRFTISRDNAKNTLYLQMSSLRSEDTALYYCARLYYGDYWGQGTTLTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 781 - protein, 441 aa, Artificial
  antibody sequence
QVQLKQSGPSLVQPSQSLSITCTVSGFSLTTYGLHWIRQSPGKGLEWLGVIWRGGTTDYNAAFMSRLTITKDNSKSQVFFKMNSLQADDTAIYYCARTDIWGAGTTVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 782 - protein, 441 aa, Artificial; identical to SEQ ID NO: 781
  antibody sequence

SEQ ID NO: 783 - protein, 441 aa, Artificial; identical to SEQ ID NO: 781
  antibody sequence

SEQ ID NO: 784 - protein, 441 aa, Artificial
  antibody sequence
QVQLKQSGPGLVQPSQSLPITCTVSGFSLTTYGLHWIRQSPGKGLEWLGVIWRGGTTDYNAAFMSRLTITKDNSKSQVFFKMNSLQADDTAIYYCARTDIWGAGTTVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 785 - protein, 441 aa, Artificial
  antibody sequence
QVQLKQSGPGLVQPSQSLSITCTVSGFSLTTYGLHWIRQSPGKGLEWLGVIWRGGTTDYNAAFMSRLTITKDNSKSQVFFKMNSLQADDTAIYYCARTDIWGAGTTVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 786 - protein, 441 aa, Artificial; identical to SEQ ID NO: 781
  antibody sequence

SEQ ID NO: 787 - protein, 441 aa, Artificial
  antibody sequence
QVQLKQSGPGLVQPSQSLSITCTVSGFSLTSYGVHWVRQPPGKGLEWLGVIWSGGITDYNAAFISRLSISKDNSKSQVFFKMNSLQADDTAIYYCARTDLWGQGTLVTVSAAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 788 - protein, 450 aa, Artificial
  antibody sequence
QVQLQQSGAELMNPGASVKISCKSTGYKFSSYWIEWVKQRPGHGLEWMGEILPGSGSTNHNEKFKGKAIFTADASSNTAYMELSSLTSEDSAVYYCARTISTATDWFAYWGQGTLVTVSAAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 789 - protein, 450 aa, Artificial; identical to SEQ ID NO: 788
  antibody sequence

SEQ ID NO: 790 - protein, 450 aa, Artificial
  antibody sequence
QVQLQQSGAELMKPGASVKMSCKATGYKFSSYWIEWVKQRPGHGLEWMGEILPGSGSTNHNEKFKGKAIFTADASSNTAYMELSSLTSEDSAVYYCARTISTATDWFAYWGQGTLVTVSAAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 791 - protein, 450 aa, Artificial
  antibody sequence
QVQLQQSGAELMKPGASVKMSCKATGYKFSSYWIEWVKQRPGHGLEWMGEILPGSGSTNHNEKFTGRAIFTADASSNTAYMELSSLTSEDSAVYYCARTISTATDWFAYWGQGTLVTVSAAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 792 - protein, 450 aa, Artificial; identical to SEQ ID NO: 790
  antibody sequence

SEQ ID NO: 793 - protein, 450 aa, Artificial
  antibody sequence
QVQLQQSGAELMKPGASVKMPCKATGYKFSSYWIEWVKQRPGHGLEWMGEILPGSGSTNHNEKFKGKAIFTADASSNTAYMELSSLTSEDSAVYYCARTISTATDWFAYWGQGTLVTVSAAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 794 - protein, 447 aa, Artificial
  antibody sequence
EVQLQQSGAELVRPGALVKLSCKASGFNIKDYYMHWVKQRPEQGLEWIGWIDPENGNTIYDPKFQGKASITADTSSNTAYLQLSSLTSEDTAVYYCARYDGYAMDYWGQGTSVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 795 - protein, 442 aa, Artificial
  antibody sequence
QVQLQQSGAELVRPGTSVKMSCKAAGYTFTNYWIGWVKQRPGHGLEWIGDIYPGGGYTNYNEKFKDKTTLTADTSSNTAYMQLSSLTSEDSAIYYCASNDCWGQGTTLTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 796 - protein, 449 aa, Artificial
  antibody sequence
QVQLKQSGPGLVQPSQSLSITCTVSGFSITSYGVHWIRQSPGKGLEWLGVIWSGGSTDYNAAFISRLSISEDNSKSQVFFKMNSLQANDTAIYYCATFYYDYDEGFDYWGQGTTLTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 797 - protein, 449 aa, Artificial
  antibody sequence
QVQLKQSGPGLVQPSQSLSITCTVSGFSITSYGVHWIRQSPGKGLEWLGVIWSGGSTDYNAAFISRLSISKDNSKSQVFFKMNSLQANDTAIYYCATFYYDYDEGFDYWGQGTTLTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 798 - protein, 449 aa, Artificial; identical to SEQ ID NO: 797
  antibody sequence

SEQ ID NO: 799 - protein, 449 aa, Artificial; identical to SEQ ID NO: 797
  antibody sequence

SEQ ID NO: 800 - protein, 449 aa, Artificial; identical to SEQ ID NO: 797
  antibody sequence

SEQ ID NO: 801 - protein, 449 aa, Artificial; identical to SEQ ID NO: 797
  antibody sequence

SEQ ID NO: 802 - protein, 449 aa, Artificial
  antibody sequence
QVQLKESGPGLVAPSQSLSITCTVSGLSLTSYGLSWVRQPPGKGLEWLGVIWGDGSTNYHSALISRLSISKDNSKSQVFLKLNSLQSDDTATYYCATRGDYGSYAMDYWGQGTSVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 803 - protein, 446 aa, Artificial
  antibody sequence
EVQLQQSGAELVRPGASVKLSCTASGFNIKDSLIHWVKQRPEQGLEWIGWIDPEDGETKYAPKFQDKAALTTDTSSNTAYLHLNSLTSEDTAIYYCGRGGLILDYWGQGTTLTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 804 - protein, 449 aa, Artificial
  antibody sequence
QIQLVQSGPELKKPGETVKISCRSSGYTFTNYGLNWVKQAPGKDLKWMGWLNTYTGEPTYADDFKGRFAFSLETSAGTAYLQINNLKNEDTATYFCSRDYREGDAMDYWSQGTSVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 805 - protein, 448 aa, Artificial
  antibody sequence
EVQLVESGGGLVKPGGSLKLSCAASGFTFSSYAMSWVRQTPEKRLEWVATISTSGSYTYYRDSVKGRLTISRDNAKNTLYLQMTSLRSEDTAMYYCTRHGDHDGFDYWGQGTTLTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 806 - protein, 448 aa, Artificial
  antibody sequence
EVQLVESGGGLVKPGGSLKLSCVASGFSFSNYAMSWVRQTPERRLEWVATINSGGSFSFFPDSVKGRFTISRDSAKNTLYLQMSSLRSDDTAMYYCTRHWDHPWFAYWGQGTLVTVSAAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 807 - protein, 448 aa, Artificial; identical to SEQ ID NO: 806
  antibody sequence

SEQ ID NO: 808 - protein, 448 aa, Artificial; identical to SEQ ID NO: 806
  antibody sequence

SEQ ID NO: 809 - protein, 444 aa, Artificial
  antibody sequence
EVQLQQSGAELVRPGASVKLSCTTSGFNIKDSLIYWVKQRPEQGLEWIGWIDPEDGETKFAPRFQDKATITSDTSSNTAYLRLSSLTSKDTAIYYCTRSFGVCWGQGTLVTVSAAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 810 - protein, 444 aa, Artificial; identical to SEQ ID NO: 284
  antibody sequence

SEQ ID NO: 811 - protein, 444 aa, Artificial; identical to SEQ ID NO: 284
  antibody sequence

SEQ ID NO: 812 - protein, 444 aa, Artificial; identical to SEQ ID NO: 284
  antibody sequence

SEQ ID NO: 813 - protein, 444 aa, Artificial; identical to SEQ ID NO: 284
  antibody sequence

SEQ ID NO: 814 - protein, 444 aa, Artificial; identical to SEQ ID NO: 284
  antibody sequence

SEQ ID NO: 815 - protein, 444 aa, Artificial; identical to SEQ ID NO: 284
  antibody sequence

SEQ ID NO: 816 - protein, 444 aa, Artificial; identical to SEQ ID NO: 284
  antibody sequence

SEQ ID NO: 817 - protein, 444 aa, Artificial; identical to SEQ ID NO: 284
  antibody sequence

SEQ ID NO: 818 - protein, 444 aa, Artificial; identical to SEQ ID NO: 284
  antibody sequence

SEQ ID NO: 819 - protein, 444 aa, Artificial; identical to SEQ ID NO: 284
  antibody sequence

SEQ ID NO: 820 - protein, 444 aa, Artificial; identical to SEQ ID NO: 284
  antibody sequence

SEQ ID NO: 821 - protein, 444 aa, Artificial; identical to SEQ ID NO: 284
  antibody sequence

SEQ ID NO: 822 - protein, 444 aa, Artificial; identical to SEQ ID NO: 284
  antibody sequence

SEQ ID NO: 823 - protein, 444 aa, Artificial; identical to SEQ ID NO: 284
  antibody sequence

SEQ ID NO: 824 - protein, 323 aa, Staphylococcus aureus
MGSSHHHHHHSSGLVPAGSHMLAQHITPVSEKKVDDKITLYKTTATSDNDKLNISQILTFNFIKDKSYDKDTLVLKAAGNINSGYKKPNPKDYNYSQFYWGGKYNVSVSSESNDAVNVVDYAPKNQNEEFQVQQTLGYSYGGDINISNGLSGGLNGSKSFSETINYKQESYRTTIDRKTNHKSIGWGVEAHKIMNNGWGPYGRDSYDPTYGNELFLGGRQSSSNAGQNFLPTHQMPLLARGNFNPEFISVLSHKQNDTKKSKIKVTYQREMDRYTNQWNRLHWVGNNYKNQNTVTFTSTYEVDWQNHTVKLIGTDSKETNPGV

SEQ ID NO: 825 - protein, 312 aa, Staphylococcus aureus
NSAHHHHHHGSAQHITPVSEKKVDDKITLYKTTATSDNDKLNISQILTFNFIKDKSYDKDTLVLKAAGNINSGYKKPNPKDYNYSQFYWGGKYNVSVSSESNDAVNVVDYAPKNQNEEFQVQQTLGYSYGGDINISNGLSGGLNGSKSFSETINYKQESYRTTIDRKTNHKSIGWGVEAHKIMNNGWGPYGRDSYDPTYGNELFLGGRQSSSNAGQNFLPTHQMPLLARGNFNPEFISVLSHKQNDTKKSKIKVTYQREMDRYTNQWNRLHWVGNNYKNQNTVTFTSTYEVDWQNHTVKLIGTDSKETNPGV

SEQ ID NO: 826 - protein, 294 aa, Staphylococcus aureus
NSAHHHHHHGSNTNIENIGDGAEVIKRTEDVSSKKWGVTQNVQFDFVKDKKYNKDALIVKMQGFINSRTSFSDVKGSGYELTKRMIWPFQYNIGLTTKDPNVSLINYLPKNKIETTDVGQTLGYNIGGNFQSAPSIGGNGSFNYSKTISYTQKSYVSEVDKQNSKSVKWGVKANEFVTPDGKKSAHDRYLFVQSPNGPTGSAREYFAPDNQLPPLVQSGFNPSFITTLSHEKGSSDTSEFEISYGRNLDITYATLFPRTGIYAERKHNAFVNRNFVVRYEVNWKTHEIKVKGHN

SEQ ID NO: 827 - protein, 354 aa, Staphylococcus aureus
MNSAHHHHHHHHHHGGGLNDIFEAQKIEWHEGSHKDSQDQNKKEHVDKSQQKDKRNVTNKDKNSTAPDDIGKNGKITKRTETVYDEKTNILQNLQFDFIDDPTYDKNVLLVKKQGSIHSNLKFESHKEEKNSNWLKYPSEYHVDFQVKRNRKTEILDQLPKNKISTAKVDSTFSYSSGGKFDSTKGIGRTSSNSYSKTISYNQQNYDTIASGKNNNWHVHWSVIANDLKYGGEVKNRNDELLFYRNTRIATVENPELSFASKYRYPALVRSGFNPEFLTYLSNEKSNEKTQFEVTYTRNQDILKNRPGIHYAPPILEKNKDGQRLIVTYEVDWKNKTVKVVDKYSDDNKPYKAG

SEQ ID NO: 828 - protein, 310 aa, Staphylococcus aureus
MKINSEIKQVSEKNLDGDTKMYTRTATTSDSQKNITQSLQFNFLTEPNYDKETVFIKAKGTIGSGLRILDPNGYWNSTLRWPGSYSVSIQNVDDNNNTNVTDFAPKNQDESREVKYTYGYKTGGDFSINRGGLTGNITKESNYSETISYQQPSYRTLLDQSTSHKGVGWKVEAHLINNMGHDHTRQLTNDSDNRTKSEIFSLTRNGNLWAKDNFTPKDKMPVTVSEGFNPEFLAVMSHDKKDKGKSQFVVHYKRSMDEFKIDWNRHGFWGYWSGENHVDKKEEKLSALYEVDWKTHNVKFVKVLNDNEKK

SEQ ID NO: 829 - protein, 332 aa, Staphylococcus aureus
NSAHHHHHHGSHKDSQDQNKKEHVDKSQQKDKRNVTNKDKNSTAPDDIGKNGKITKRTETVYDEKTNILQNLQFDFIDDPTYDKNVLLVKKQGSIHSNLKFESHKEEKNSNWLKYPSEYHVDFQVKRNRKTEILDQLPKNKISTAKVDSTFSYSSGGKFDSTKGIGRTSSNSYSKTISYNQQNYDTIASGKNNNWHVHWSVIANDLKYGGEVKNRNDELLFYRNTRIATVENPELSFASKYRYPALVRSGFNPEFLTYLSNEKSNEKTQFEVTYTRNQDILKNRPGIHYAPPILEKNKDGQRLIVTYEVDWKNKTVKVVDKYSDDNKPYKEG

SEQ ID NO: 830 - protein, 309 aa, Staphylococcus aureus
KINSEIKQVSEKNLDGDTKMYTRTATTSDSQKNITQSLQFNFLTEPNYDKETVFIKAKGTIGSGLRILDPNGYWNSTLRWPGSYSVSIQNVDDNNNTNVTDFAPKNQDESREVKYTYGYKTGGDFSINRGGLTGNITKESNYSETISYQQPSYRTLLDQSTSHKGVGWKVEAHLINNMGHDHTRQLTNDSDNRTKSEIFSLTRNGNLWAKDNFTPKDKMPVTVSEGFNPEFLAVMSHDKKDKGKSQFVVHYKRSMDEFKIDWNRHGFWGYWSGENHVDKKEEKLSALYEVDWKTHNVKFVKVLNDNEKK

SEQ ID NO: 831 - protein, 257 aa, Staphylococcus aureus
MGSSHHHHHHSSGLVPRGSHMGSNLRQQPQKFPEALRGCPQEDSDIAFLIDGSGSIIPHDFRRMKEFVSTVMEQLKKSKTLFSLMQYSEEFRIHFTFKEFQNNPNPRSLVKPITQLLGRTHTATGIRKVVRELFNITNGARKNAFKILVVITDGEKFGDPLGYEDVIPEADREGVIRYVIGVGDAFRSEKSRQELNTIASKPPRDHVFQVNNFEALKTIQNQLREKIFAGGGGGGDYKDHDGDYKDHDIDYKDDDDK

SEQ ID NO: 832 - protein, 291 aa, Staphylococcus aureus
NSAHHHHHHGSENKIEDIGQGAEIIKRTQDITSKRLAITQNIQFDFVKDKKYNKDALVVKMQGFISSRTTYSDLKKYPYIKRMIWPFQYNISLKTKDSNVDLINYLPKNKIDSADVSQKLGYNIGGNFQSAPSIGGSGSFNYSKTISYNQKNYVTEVESQNSKGVKWGVKANSFVTPNGQVSAYDQYLFAQDPTGPAARDYFVPDNQLPPLIQSGFNPSFITTLSHERGKGDKSEFEITYGRNMDATYAYVTRHRLAVDRKHDAFKNRNVTVKYEVNWKTHEVKIKSITPK

SEQ ID NO: 833 - protein, 297 aa, Staphylococcus aureus
NSAHHHHHHGSANDTEDIGKGSDIEIIKRTEDKTSNKWGVTQNIQFDFVKDKKYNKDALILKMQGFISSRTTYYNYKKTNHVKAMRWPFQYNIGLKTNDKYVSLINYLPKNKIESTNVSQTLGYNIGGNFQSAPSLGGNGSFNYSKSISYTQQNYVSEVEQQNSKSVLWGVKANSFATESGQKSAFDSDLFVGYKPHSKDPRDYFVPDSELPPLVQSGFNPSFIATVSHEKGSSDTSEFEITYGRNMDVTHAIKRSTHYGNSYLDGHRVHNAFVNRNYTVKYEVNWKTHEIKVKGQN

SEQ ID NO: 834 - DNA, 1323 bp, Artificial
  antibody sequence
gaggttcagctgcagcagtctggggctgagctgatgacgcctggggcctcagtgaagatatcctgcaaggctactggctacacattcagtaccttttggatagagtggatcaagcagaggcctggacatggccttgagtggattggagagattttacctggaagtggtagtactaagtacaatgagaagttcaagggcaaggccacattcactgcagatacatcctccaacacagcctacatgcaactcagcagcctgacatctgaggactctgccgtctattattgtgcaagaggtggttacgatggtatggactactggggtcaaggaacctcagtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctggagtctgacctctacactctgagcagctcagtgactgtcccctccagccctcggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatgaacacgaatggctcttacttcgtctacagcaagctcaatgtgcagaagagcaactgggaggcaggaaatactttcacctgctctgtgttacatgagggcctgcacaaccaccatactgagaagagcctctcccactctcctggtaaa

SEQ ID NO: 835 - DNA, 1323 bp, Artificial
  antibody sequence
gaggttcagctgcagcagtctggggctgagctgatgacgcctggggcctcagtgaagatatcctgcaaggctactggctacacattcagtaccttttggatagagtggatcaagcagaggcctggacatggccttgagtggattggagagattttacctggaagtggtagtactaagtacaatgagaagttcaagggcaaggccacattcactgcagatacatcctccaacacagcctacatgcaactcagcagcctgtcatctgaggactctgccgtctattattgtgcaagaggtggttacgatggtatggactactggggtcaaggaacctcagtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctggagtctgacctctacactctgagcagctcagtgactgtcccctccagccctcggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatgaacacgaatggctcttacttcgtctacagcaagctcaatgtgcagaagagcaactgggaggcaggaaatactttcacctgctctgtgttacatgagggcctgcacaaccaccatactgagaagagcctctcccactctcctggtaaa

SEQ ID NO: 836 - DNA, 1323 bp, Artificial
  antibody sequence
gaggttcagctgcagcagtctgaggctgagctgatgacgcctggggcctcagtgaagatatcctgcaaggctactggctacacattcagtaccttttggatagagtggatcaagcagaggcctggacatggccttgagtggattggagagattttacctggaagtggtagtactaagtacaatgagaagttcaagggcaaggccacattcactgcagatacatcctccaacacagcctacatgcaactcagcagcctgacatctgaggactctgccgtctattattgtgcaagaggtggttacgatggtatggactactggggtcaaggaacctcagtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctggagtctgacctctacactctgagcagctcagtgactgtcccctccagccctcggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatgaacacgaatggctcttacttcgtctacagcaagctcaatgtgcagaagagcaactgggaggcaggaaatactttcacctgctctgtgttacatgagggcctgcacaaccaccatactgagaagagcctctcccactctcctggtaaa

SEQ ID NO: 837 - DNA, 1335 bp, Artificial
  antibody sequence
gaggttcagctgcagcagtctggggctgagctggtgaagcctggggcctcagtgaagatttcctgcaaggcttctggctatgcattcagtagctcctggatgaactgggtgaagcagaggcctggaaagggtcttgagtggattggacggatttatcctggagatggagatactaactaccatgggaagttcaagggcaaggccacactgactgcagacaaatcctccagcacagcctacatgcaactcagcagcctgacatctgaggactctgcggtctacttctgtgcaagaaggaactatgatggttaccactatggtatggactactggggtcaaggaacctcagtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctggagtctgacctctacactctgagcagctcagtgactgtcccctccagccctcggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatgaacacgaatggctcttacttcgtctacagcaagctcaatgtgcagaagagcaactgggaggcaggaaatactttcacctgctctgtgttacatgagggcctgcacaaccaccatactgagaagagcctctcccactctcctggtaaa

SEQ ID NO: 838 - DNA, 1323 bp, Artificial; identical to SEQ ID NO: 834
  antibody sequence

SEQ ID NO: 839 - DNA, 1332 bp, Artificial
  antibody sequence
gaggttcagctgcagcagtctggggctgagctggtcaagcctgggacttcagtgaagatgtcctgcaaggcttctggctacaccttcaccagctactggatgcactgggtgaaacttaggcctggacaaggccttgagtggatcggagtgattgatccttctgatagttatactaactataatcaaaagttcaagggcagggccacattgactggagacacatcctccagcacagcctacatgcagctcagcagcctgacatctgaggactctgcggtctattactgtacaagagcagcatatgataactcgtactactttgactactggggccaaggcaccactctcacagtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctggagtctgacctctacactctgagcagctcagtgactgtcccctccagccctcggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatgaacacgaatggctcttacttcgtctacagcaagctcaatgtgcagaagagcaactgggaggcaggaaatactttcacctgctctgtgttacatgagggcctgcacaaccaccatactgagaagagcctctcccactctcctggtaaa

SEQ ID NO: 840 - DNA, 1344 bp, Artificial
  antibody sequence
gaggttcagctgcagcagtctggggctgagctggtgaagcctggggcctcagtgaagatttcctgcaaggcttctggctatgcattcagtagttcctggatgaactggttgaagcagaggcctggaaagggtcttgagtggattggacggatttatcctggagatggagatactaattacaatgggaagttcaagggcaaggccacactgactgcagacaagtcctccagtacagcctacatgcaactcagcagcctgacatctgaggactctgcggtctacttctgtgcaagatacggctatgattacgacggggaatattactatgctatggactactggggtcaaggaacctcagtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctggagtctgacctctacactctgagcagctcagtgactgtcccctccagccctcggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatgaacacgaatggctcttacttcgtctacagcaagctcaatgtgcagaagagcaactgggaggcaggaaatactttcacctgctctgtgttacatgagggcctgcacaaccaccatactgagaagagcctctcccactctcctggtaaa

SEQ ID NO: 841 - DNA, 1323 bp, Artificial
  antibody sequence
caggtgcagctgaaggagtcaggacctgaactgaagaagcctggagagacagtcaggatctcctgcaaggcttctgggtatactttcacaaattatggaatgaactgggtgaagcagactccaggaaagggtttaaagtggatagactggttaaagtcctacactggagagccaacacatactggtgacttcaagggacggtttgacctctctttggaaacctctgccaacactgcctatttgcagatcaacaacctcaaaaatgaggacacggctacatatttctgtgcaagagggtccctctttggtttggactactggggtcaaggaacctcagtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctggagtctgacctctacactctgagcagctcagtgactgtcccctccagccctcggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatgaacacgaatggctcttacttcgtctacagcaagctcaatgtgcagaagagcaactgggaggcaggaaatactttcacctgctctgtgttacatgagggcctgcacaaccaccatactgagaagagcctctcccactctcctggtaaa

SEQ ID NO: 842 - DNA, 1347 bp, Artificial
  antibody sequence
gaagtccagctgcagcagagcggagccgagctggtcaaaagcggagccagcgtgaagctgagctgcaccgccagcggcttcaacatcaaggactactacatgcactgggtcaagcagcggcccgagcagggcctggaatggatcggaagaatcgaccccgccaacggcaacaccaaatacgaccccaagttccaggacaaggccaccatcaccagcgacaccagcagcaacaccgcctacctgcagctgagcagcctgaccagcgaggacaccgccgtgtactactgcgccgagggcgattacgtgcccggctactttgatgtgtggggagccggcaccaccgtgaccgtgtcatctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaa

SEQ ID NO: 843 - DNA, 1344 bp, Artificial
  antibody sequence
gaggtccagctgcaggaatctggccctagcctggtcaagcccagccagaccctgagcctgacctgtagcgtgaccggcgacagcatcaccagcgactactggaactggatccggaagttccccggcaacaagctcgagtacatgggctacatcagctacagcggcagcacctactacaaccccagcctgaagtcccggatctccatcacccgggacaccagcaagaaccagtactatctgcagctgaacagcgtgaccaccgaggacaccgccacctactattgtgccggcgactacggcagcccctacgccatggattattggggccagggcacctccgtgaccgtgtctagtgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaa

SEQ ID NO: 844 - DNA, 1356 bp, Artificial
  antibody sequence
caggtccagctgcagcagtctggcgctgaactggccaagcctggggccagcgtgaagatgagctgcaagagcagcggctacaccttcagcacctactggatgcactgggtcaagcagaggccaggccagggcctggaatggatcggctacatcaaccccaacaccggctacacagagtacaaccagaagttcaaggacaccgccaccctgaccgccgacaagtctagcagcaccgcctacatgcagctgagcagcctgaccagcgaggacagcgccgtgtactattgtgccagaggcggcagcaaggccttcccctactacgccatggactattggggccagggcaccagcgtgaccgtgtctagtgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaa

SEQ ID NO: 845 - DNA, 1347 bp, Artificial
  antibody sequence
gagatccagctgcagcagtctggccctgagctggtcaagcctggggccagcgtgaagatgagctgcaaggccagcggctacagcttcaccggctacaacatgcactgggtcaagcagagccacggcaagagcctggaatggatcggctacatcgacccctacaacggggccaccagccacaaccagaagttcaagggcaaggccaccctgaccgtggaaaagagcagcagcaccgcctacatgcagctgaacagcctgaccagcgaggacagcgccgtgtactactgcgccagaggcctgtacggcgactattggtacgcctattggggccagggcaccctggtcaccgtgtctagtgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaa

SEQ ID NO: 846 - DNA, 1344 bp, Artificial
  antibody sequence
gaggtgcagctggtggaatctggcggaggactggtcaagcctggcggcagcctgaaactgtcttgcgccgccagcggcttcaccttcagcgactactacatgtactgggtccgacagacccctgagaagcggctggaatgggtggccacaatcagcgacggcggcagctacaccttctaccccgacagcgtgaagggccggttcaccatcagccgggacaacgccaagaacaacctgtacctgcagatgtccagcctgaagtccgaggacaccgccatgtactactgcgccagaggccccacctactacggcctggattattggggccagggcaccaccctgaccgtgtctagtgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaa

SEQ ID NO: 847 - DNA, 1341 bp, Artificial
  antibody sequence
caggtccagctgcagcagcctggcgctgaactcgtcagacctggcgcttctgtgcggctgagctgcaaggccagcggctacagcttcaccagctactggatgagctgggtcaaagtgcggccaggccagggcctggaatggatcggaatgatccaccccagcgacagcgagacacggctgaaccagaagttcaaggacaaggccaccctgaccgtggacaagagcagcagcaccgcctacatgcagctgtccagccccacaagcgaggacagcgccgtgtactactgcgccagactgtacgtggacttcttcgactactggggccagggcaccacactgacagtgtcctctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaa

SEQ ID NO: 848 - DNA, 1344 bp, Artificial
  antibody sequence
gacgtgaagctggtggaatctggcggcggactggtcaagctgggcggcagcctgaaactgtcttgcgccgccagcggcttcaccttcagcagctactacatgagctgggtccgacagacccctgagaagcggctggaactggtggccgccatcaacagcaatggcggcagcacctactaccccgacaccgtgaagggccggttcaccatctcccgggacaacgccaagaacaccctgtacctgcagatgtccagcctgaagtccgaggacaccgccctgtactactgcgccagacccgactacccctacgccatggattactggggccagggcaccagcgtgaccgtgtcatctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaa

SEQ ID NO: 849 - DNA, 1356 bp, Artificial
  antibody sequence
cagatccagctggtgcagagcggccctgagctgaagaaacccggcgagacagtgaagatcagctgcaaggccagcggctacaccttcaccaactacggcatgaactgggtcaagcaggcccctggcaagggcctgaagtggatgggctggatcaacacctacaccggcgagcccacctacgccgacgacttcaagggcagattcgccttcagcctggaaaccagcgccagcaccgcctacctgcagatcaacaacctgaagaacgaggacaccgccacctacttttgcgccagaagccccagctacggcagcagaggcgcttggtttgcctattggagccagggcaccctggtcaccgtgtctgctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaa

SEQ ID NO: 850 - DNA, 1356 bp, Artificial
  antibody sequence
cagatccagctggtgcagagcggccctgagctgaagaaacccggcgagacagtgaagatcagctgcaaggccagcggctacaccttcaccaactacggcatgaactgggtcaagcaggcccctggcaagggcctgaagtggatgggctggatcaacacctacaccggcgagcccacctacgccgacgacttcaagggcagattcgccttcagcctggaaaccagcgccagcaccgcctacctgcagatcaacaacctgaagaacgaggacaccgccacctacttttgcgccagaagccccagctacggcagcagaggcgcttggtttgcctactggggccagggcaccctggtcacagtgtctgctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaa

SEQ ID NO: 851 - DNA, 1338 bp, Artificial
  antibody sequence
caggtccagctgcagcagagcggagccgaactgatgaagcctggggccagcgtgaagatcagctgcaaggccagcggctacaccttcagcgactactggatcgagtggatcaagcagcggcctggccacggcctggaatggatgggagagatcctgcccggcagcgacaagaccaactacaacgagaagttcaagggcaaggccaccttcaccgccgacagcagcagcaacaccgcctacatgcagctgaacagcctgaccagcgaggacagcgccgtgttctattgtgccacagccggcgacgactacgtgaagtggggacagggcaccctggtcaccgtgtctgctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaa

SEQ ID NO: 852 - DNA, 1332 bp, Artificial
  antibody sequence
gaagtccagctgcagcagagcggagccgaactggtcaagcctggcgcttccgtgaagctgagctgcaccgccagcggcttcaacatcaaggacacctacatgcactgggtccgacagaggcccgagcagggcctggaatggatcggcagaatcgaccccgccaacgacatcaccaaatacgaccccaagttccagggcaaggccaccatcaccgccgacaccagcagcaacacagcctacctgcagctgagcagcctgaccagcgaggacaccgccgtgtactactgcggcagagactgggccgattactggggccagggcaccaccctgacagtgtctagtgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaa

SEQ ID NO: 853 - DNA, 1332 bp, Artificial
  antibody sequence
gaagtccagctgcagcagagcggagccgaactggtcaagcctggcgcttccgtgaagctgagctgcaccgccagcggcttcaacatcaaggacacctacatgcactgggtcaagcagcggagcgagcagggcctggaatggatcggcagaatcaaccccgccaacgacaacaccaaatacgaccccaagttccagggcaaggccaccatcaccgccgacaccagcagcaacacagcctacctgcagctgagcagcctgaccagcgaggacaccgccgtgtactactgcggcagagactgggccgattactggggccagggcaccaccctgacagtgtctagtgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaa

SEQ ID NO: 854 - DNA, 1347 bp, Artificial
  antibody sequence
caggtccagctgcagcagcctggcgctgaactggtcaagccaggcgcttccgtgaagctgagctgcaaggccagcggctacaccttcacccggtactggatgcactgggtcaagcagaggccaggccagggcctggaatggatcggcgagatcaaccccaacaacggccacaccaactacaacgagaagttcgagagccgggccaccctgaccgtggacaagagcagcagcaccgcctacatgcagttcaacagcctgaccagcgaggacagcgccgtgtactactgcggcagactggatggccacctgtacgccgtggattactggggccagggcaccagcgtgaccgtgtcatctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaa

SEQ ID NO: 855 - DNA, 1347 bp, Artificial
  antibody sequence
caggtccagctgcagcagcctggcacagagctgaagatgcccggcaccagcgtgaagctgagctgcaaggccagcggctacaccttcaccacctactggatgcactgggtcaagctgcggccaggccagggctttgagtggatcggcgagatcaaccccagcaacgacggcaccaactacaacgagaagttcaagcggaaggccaccctgaccgtggacaagcctagcagcaccgcctacatgcagctgtccagcctgaccagcgaggacagcaccatctactactgcaccatcagctactacggctacggcgacttcgactactggggccagggcaccacactgacagtgtcctctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaa

SEQ ID NO: 856 - DNA, 1347 bp, Artificial
  antibody sequence
caggtgcagctgaaagagtccggccctgatctggtgcagcccagccagaccctgagcctgacctgtaccgtgtccggcttcagcctgaccagctacggcgtgcactgggtccgacagccacctggcaaaggcctggaatgggtcggaaccatgggctggaacgacaagaagtactacaacagcgccctgaagtcccggctgagcatcagcagaaacaccagcaagaaccaggtgttcctgaagctgagcagcctgcagaccgaggacaccgccatgtactactgcaccagggacggcgatagcagcggcagttggttcgcctattggggccagggcaccctggtcaccgtgtctagtgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaa

SEQ ID NO: 857 - DNA, 1341 bp, Artificial
  antibody sequence
caggtgcagctgaaagagtccggccctgatctggtgcagcccagccagaccctgagcctgacctgtaccgtgtccggcttcagcctgacaggctacgctgtgcattgggtccgacagcctccaggcaagggcgtggaatgggtcggaaccatgggctgggacgacaagaagttctacaacagcgccctgaagtcccggctgagcatctccagggaccccagcaagaaccaggtgttcttcaagctgagcagcctgcagaccgaggacaccgccatgtactactgcaccagggatcacggcgacggcggctttgcctattggggccagggaaccctggtcaccgtgtcctctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaa

SEQ ID NO: 858 - DNA, 1353 bp, Artificial
  antibody sequence
gaagtccagctgcagcagtctggccctgagctggtcaagcctggggccagcgtgaagatcccatgcaaggccagcggctacaccttcaccgactacaacatggactgggtcaagcagagccacggcaagagcctggaatggatcggcaacatcaaccccaacaacggcggcaccatctacaaccagaacttcaaggaccgggccaccctgaccgtggacaagagcagcagcaccgcctacatggaactgcggagcctgaccagcgaggacaccgccgtgtactactgcaccagagagaactccggctacggcggcaactacttcgcctattggggccagggcaccacactgacagtgtcctctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaa

SEQ ID NO: 859 - DNA, 1332 bp, Artificial
  antibody sequence
gaagtccagctgcagcagagcggagccgaactcgtcagacctggcgcttccgtgaagctgagctgcaccaccagcggcttcaacatcaaggacagcctgatctactgggtcaagcagcggcccgagcagggcctggaatggatcggctggattgaccccgaggacggcgagacaaagttcgcccctagattccaggacaaggccaccatcaccagcgacaccagcagcaacaccgcctacctgagactgagcagcctgaccagcgaggacaccgccatctactactgcacccggtccttcggcgtgtgttggggccagggaaccctggtcacagtgtctgctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaa

SEQ ID NO: 860 - DNA, 1332 bp, Artificial; identical to SEQ ID NO: 859
  antibody sequence

SEQ ID NO: 861 - DNA, 1332 bp, Artificial; identical to SEQ ID NO: 859
  antibody sequence

SEQ ID NO: 862 - DNA, 1332 bp, Artificial; identical to SEQ ID NO: 859
  antibody sequence

SEQ ID NO: 863 - DNA, 1332 bp, Artificial; identical to SEQ ID NO: 859
  antibody sequence

SEQ ID NO: 864 - DNA, 1332 bp, Artificial; identical to SEQ ID NO: 859
  antibody sequence

SEQ ID NO: 865 - DNA, 1332 bp, Artificial; identical to SEQ ID NO: 859
  antibody sequence

SEQ ID NO: 866 - DNA, 1332 bp, Artificial; identical to SEQ ID NO: 859
  antibody sequence

SEQ ID NO: 867 - DNA, 1332 bp, Artificial; identical to SEQ ID NO: 859
  antibody sequence

SEQ ID NO: 868 - DNA, 1332 bp, Artificial; identical to SEQ ID NO: 859
  antibody sequence

SEQ ID NO: 869 - DNA, 1332 bp, Artificial; identical to SEQ ID NO: 859
  antibody sequence

SEQ ID NO: 870 - DNA, 1332 bp, Artificial; identical to SEQ ID NO: 859
  antibody sequence

SEQ ID NO: 871 - DNA, 1332 bp, Artificial; identical to SEQ ID NO: 859
  antibody sequence

SEQ ID NO: 872 - DNA, 1332 bp, Artificial; identical to SEQ ID NO: 859
  antibody sequence

SEQ ID NO: 873 - DNA, 1332 bp, Artificial; identical to SEQ ID NO: 859
  antibody sequence

SEQ ID NO: 874 - DNA, 1332 bp, Artificial; identical to SEQ ID NO: 859
  antibody sequence

SEQ ID NO: 875 - DNA, 1383 bp, Artificial
  antibody sequence
atggcttgggtgtggaccttgctattcctgatggcagctgcccaaagtatacaggccgaggttcagctgcagcagtctggggctgagctgatgacgcctggggcctcagtgaagatatcctgcaaggctactggctacacattcagtaccttttggatagagtggatcaagcagaggcctggacatggccttgagtggattggagagattttacctggaagtggtagtactaagtacaatgagaagttcaagggcaaggccacattcactgcagatacatcctccaacacagcctacatgcaactcagcagcctgacatctgaggactctgccgtctattattgtgcaagaggtggttacgatggtatggactactggggtcaaggaacctcagtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctggagtctgacctctacactctgagcagctcagtgactgtcccctccagccctcggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatgaacacgaatggctcttacttcgtctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 876 - DNA, 1383 bp, Artificial
  antibody sequence
atggcttgggtgtggaccttgctattcctgatggcagctgcccaaagtatacaggccgaggttcagctgcagcagtctggggctgagctgatgacgcctggggcctcagtgaagatatcctgcaaggctactggctacacattcagtaccttttggatagagtggatcaagcagaggcctggacatggccttgagtggattggagagattttacctggaagtggtagtactaagtacaatgagaagttcaagggcaaggccacattcactgcagatacatcctccaacacagcctacatgcaactcagcagcctgtcatctgaggactctgccgtctattattgtgcaagaggtggttacgatggtatggactactggggtcaaggaacctcagtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctggagtctgacctctacactctgagcagctcagtgactgtcccctccagccctcggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatgaacacgaatggctcttacttcgtctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 877 - DNA, 1383 bp, Artificial
  antibody sequence
atggcttgggtgtggaccttgctattcctgatggcagctgcccaaagtatacaggccgaggttcagctgcagcagtctgaggctgagctgatgacgcctggggcctcagtgaagatatcctgcaaggctactggctacacattcagtaccttttggatagagtggatcaagcagaggcctggacatggccttgagtggattggagagattttacctggaagtggtagtactaagtacaatgagaagttcaagggcaaggccacattcactgcagatacatcctccaacacagcctacatgcaactcagcagcctgacatctgaggactctgccgtctattattgtgcaagaggtggttacgatggtatggactactggggtcaaggaacctcagtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctggagtctgacctctacactctgagcagctcagtgactgtcccctccagccctcggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatgaacacgaatggctcttacttcgtctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 878 - DNA, 1395 bp, Artificial
  antibody sequence
atggcttgggtgtggaccttgctattcctgatggcagctgcccaaagtatacaggccgaggttcagctgcagcagtctggggctgagctggtgaagcctggggcctcagtgaagatttcctgcaaggcttctggctatgcattcagtagctcctggatgaactgggtgaagcagaggcctggaaagggtcttgagtggattggacggatttatcctggagatggagatactaactaccatgggaagttcaagggcaaggccacactgactgcagacaaatcctccagcacagcctacatgcaactcagcagcctgacatctgaggactctgcggtctacttctgtgcaagaaggaactatgatggttaccactatggtatggactactggggtcaaggaacctcagtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctggagtctgacctctacactctgagcagctcagtgactgtcccctccagccctcggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatgaacacgaatggctcttacttcgtctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 879 - DNA, 1383 bp, Artificial; identical to SEQ ID NO: 875
  antibody sequence

SEQ ID NO: 880 - DNA, 1392 bp, Artificial
  antibody sequence
atggcttgggtgtggaccttgctattcctgatggcagctgcccaaagtatacaggccgaggttcagctgcagcagtctggggctgagctggtcaagcctgggacttcagtgaagatgtcctgcaaggcttctggctacaccttcaccagctactggatgcactgggtgaaacttaggcctggacaaggccttgagtggatcggagtgattgatccttctgatagttatactaactataatcaaaagttcaagggcagggccacattgactggagacacatcctccagcacagcctacatgcagctcagcagcctgacatctgaggactctgcggtctattactgtacaagagcagcatatgataactcgtactactttgactactggggccaaggcaccactctcacagtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctggagtctgacctctacactctgagcagctcagtgactgtcccctccagccctcggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatgaacacgaatggctcttacttcgtctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 881 - DNA, 1404 bp, Artificial
  antibody sequence
atggcttgggtgtggaccttgctattcctgatggcagctgcccaaagtatacaggccgaggttcagctgcagcagtctggggctgagctggtgaagcctggggcctcagtgaagatttcctgcaaggcttctggctatgcattcagtagttcctggatgaactggttgaagcagaggcctggaaagggtcttgagtggattggacggatttatcctggagatggagatactaattacaatgggaagttcaagggcaaggccacactgactgcagacaagtcctccagtacagcctacatgcaactcagcagcctgacatctgaggactctgcggtctacttctgtgcaagatacggctatgattacgacggggaatattactatgctatggactactggggtcaaggaacctcagtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctggagtctgacctctacactctgagcagctcagtgactgtcccctccagccctcggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatgaacacgaatggctcttacttcgtctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 882 - DNA, 1383 bp, Artificial
  antibody sequence
atggcttgggtgtggaccttgctattcctgatggcagctgcccaaagtatacaggcccaggtgcagctgaaggagtcaggacctgaactgaagaagcctggagagacagtcaggatctcctgcaaggcttctgggtatactttcacaaattatggaatgaactgggtgaagcagactccaggaaagggtttaaagtggatagactggttaaagtcctacactggagagccaacacatactggtgacttcaagggacggtttgacctctctttggaaacctctgccaacactgcctatttgcagatcaacaacctcaaaaatgaggacacggctacatatttctgtgcaagagggtccctctttggtttggactactggggtcaaggaacctcagtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctggagtctgacctctacactctgagcagctcagtgactgtcccctccagccctcggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatgaacacgaatggctcttacttcgtctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 883 - DNA, 1407 bp, Artificial
  antibody sequence
atggcttgggtgtggaccttgctattcctgatggcagctgcccaaagtatacaggccgaagtccagctgcagcagagcggagccgagctggtcaaaagcggagccagcgtgaagctgagctgcaccgccagcggcttcaacatcaaggactactacatgcactgggtcaagcagcggcccgagcagggcctggaatggatcggaagaatcgaccccgccaacggcaacaccaaatacgaccccaagttccaggacaaggccaccatcaccagcgacaccagcagcaacaccgcctacctgcagctgagcagcctgaccagcgaggacaccgccgtgtactactgcgccgagggcgattacgtgcccggctactttgatgtgtggggagccggcaccaccgtgaccgtgtcatctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatga

SEQ ID NO: 884 - DNA, 1404 bp, Artificial
  antibody sequence
atggcttgggtgtggaccttgctattcctgatggcagctgcccaaagtatacaggccgaggtccagctgcaggaatctggccctagcctggtcaagcccagccagaccctgagcctgacctgtagcgtgaccggcgacagcatcaccagcgactactggaactggatccggaagttccccggcaacaagctcgagtacatgggctacatcagctacagcggcagcacctactacaaccccagcctgaagtcccggatctccatcacccgggacaccagcaagaaccagtactatctgcagctgaacagcgtgaccaccgaggacaccgccacctactattgtgccggcgactacggcagcccctacgccatggattattggggccagggcacctccgtgaccgtgtctagtgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatga

SEQ ID NO: 885 - DNA, 1416 bp, Artificial
  antibody sequence
atggcttgggtgtggaccttgctattcctgatggcagctgcccaaagtatacaggcccaggtccagctgcagcagtctggcgctgaactggccaagcctggggccagcgtgaagatgagctgcaagagcagcggctacaccttcagcacctactggatgcactgggtcaagcagaggccaggccagggcctggaatggatcggctacatcaaccccaacaccggctacacagagtacaaccagaagttcaaggacaccgccaccctgaccgccgacaagtctagcagcaccgcctacatgcagctgagcagcctgaccagcgaggacagcgccgtgtactattgtgccagaggcggcagcaaggccttcccctactacgccatggactattggggccagggcaccagcgtgaccgtgtctagtgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatga

SEQ ID NO: 886 - DNA, 1407 bp, Artificial
  antibody sequence
atggcttgggtgtggaccttgctattcctgatggcagctgcccaaagtatacaggccgagatccagctgcagcagtctggccctgagctggtcaagcctggggccagcgtgaagatgagctgcaaggccagcggctacagcttcaccggctacaacatgcactgggtcaagcagagccacggcaagagcctggaatggatcggctacatcgacccctacaacggggccaccagccacaaccagaagttcaagggcaaggccaccctgaccgtggaaaagagcagcagcaccgcctacatgcagctgaacagcctgaccagcgaggacagcgccgtgtactactgcgccagaggcctgtacggcgactattggtacgcctattggggccagggcaccctggtcaccgtgtctagtgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatga

SEQ ID NO: 887 - DNA, 1404 bp, Artificial
  antibody sequence
atggcttgggtgtggaccttgctattcctgatggcagctgcccaaagtatacaggccgaggtgcagctggtggaatctggcggaggactggtcaagcctggcggcagcctgaaactgtcttgcgccgccagcggcttcaccttcagcgactactacatgtactgggtccgacagacccctgagaagcggctggaatgggtggccacaatcagcgacggcggcagctacaccttctaccccgacagcgtgaagggccggttcaccatcagccgggacaacgccaagaacaacctgtacctgcagatgtccagcctgaagtccgaggacaccgccatgtactactgcgccagaggccccacctactacggcctggattattggggccagggcaccaccctgaccgtgtctagtgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatga

SEQ ID NO: 888 - DNA, 1401 bp, Artificial
  antibody sequence
atggcttgggtgtggaccttgctattcctgatggcagctgcccaaagtatacaggcccaggtccagctgcagcagcctggcgctgaactcgtcagacctggcgcttctgtgcggctgagctgcaaggccagcggctacagcttcaccagctactggatgagctgggtcaaagtgcggccaggccagggcctggaatggatcggaatgatccaccccagcgacagcgagacacggctgaaccagaagttcaaggacaaggccaccctgaccgtggacaagagcagcagcaccgcctacatgcagctgtccagccccacaagcgaggacagcgccgtgtactactgcgccagactgtacgtggacttcttcgactactggggccagggcaccacactgacagtgtcctctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatga

SEQ ID NO: 889 - DNA, 1404 bp, Artificial
  antibody sequence
atggcttgggtgtggaccttgctattcctgatggcagctgcccaaagtatacaggccgacgtgaagctggtggaatctggcggcggactggtcaagctgggcggcagcctgaaactgtcttgcgccgccagcggcttcaccttcagcagctactacatgagctgggtccgacagacccctgagaagcggctggaactggtggccgccatcaacagcaatggcggcagcacctactaccccgacaccgtgaagggccggttcaccatctcccgggacaacgccaagaacaccctgtacctgcagatgtccagcctgaagtccgaggacaccgccctgtactactgcgccagacccgactacccctacgccatggattactggggccagggcaccagcgtgaccgtgtcatctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatga

SEQ ID NO: 890 - DNA, 1416 bp, Artificial
  antibody sequence
atggcttgggtgtggaccttgctattcctgatggcagctgcccaaagtatacaggcccagatccagctggtgcagagcggccctgagctgaagaaacccggcgagacagtgaagatcagctgcaaggccagcggctacaccttcaccaactacggcatgaactgggtcaagcaggcccctggcaagggcctgaagtggatgggctggatcaacacctacaccggcgagcccacctacgccgacgacttcaagggcagattcgccttcagcctggaaaccagcgccagcaccgcctacctgcagatcaacaacctgaagaacgaggacaccgccacctacttttgcgccagaagccccagctacggcagcagaggcgcttggtttgcctattggagccagggcaccctggtcaccgtgtctgctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatga

SEQ ID NO: 891 - DNA, 1416 bp, Artificial
  antibody sequence
atggcttgggtgtggaccttgctattcctgatggcagctgcccaaagtatacaggcccagatccagctggtgcagagcggccctgagctgaagaaacccggcgagacagtgaagatcagctgcaaggccagcggctacaccttcaccaactacggcatgaactgggtcaagcaggcccctggcaagggcctgaagtggatgggctggatcaacacctacaccggcgagcccacctacgccgacgacttcaagggcagattcgccttcagcctggaaaccagcgccagcaccgcctacctgcagatcaacaacctgaagaacgaggacaccgccacctacttttgcgccagaagccccagctacggcagcagaggcgcttggtttgcctactggggccagggcaccctggtcacagtgtctgctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatga

SEQ ID NO: 892 - DNA, 1398 bp, Artificial
  antibody sequence
atggcttgggtgtggaccttgctattcctgatggcagctgcccaaagtatacaggcccaggtccagctgcagcagagcggagccgaactgatgaagcctggggccagcgtgaagatcagctgcaaggccagcggctacaccttcagcgactactggatcgagtggatcaagcagcggcctggccacggcctggaatggatgggagagatcctgcccggcagcgacaagaccaactacaacgagaagttcaagggcaaggccaccttcaccgccgacagcagcagcaacaccgcctacatgcagctgaacagcctgaccagcgaggacagcgccgtgttctattgtgccacagccggcgacgactacgtgaagtggggacagggcaccctggtcaccgtgtctgctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatga

SEQ ID NO: 893 - DNA, 1392 bp, Artificial
  antibody sequence
atggcttgggtgtggaccttgctattcctgatggcagctgcccaaagtatacaggccgaagtccagctgcagcagagcggagccgaactggtcaagcctggcgcttccgtgaagctgagctgcaccgccagcggcttcaacatcaaggacacctacatgcactgggtccgacagaggcccgagcagggcctggaatggatcggcagaatcgaccccgccaacgacatcaccaaatacgaccccaagttccagggcaaggccaccatcaccgccgacaccagcagcaacacagcctacctgcagctgagcagcctgaccagcgaggacaccgccgtgtactactgcggcagagactgggccgattactggggccagggcaccaccctgacagtgtctagtgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatga

SEQ ID NO: 894 - DNA, 1392 bp, Artificial
  antibody sequence
atggcttgggtgtggaccttgctattcctgatggcagctgcccaaagtatacaggccgaagtccagctgcagcagagcggagccgaactggtcaagcctggcgcttccgtgaagctgagctgcaccgccagcggcttcaacatcaaggacacctacatgcactgggtcaagcagcggagcgagcagggcctggaatggatcggcagaatcaaccccgccaacgacaacaccaaatacgaccccaagttccagggcaaggccaccatcaccgccgacaccagcagcaacacagcctacctgcagctgagcagcctgaccagcgaggacaccgccgtgtactactgcggcagagactgggccgattactggggccagggcaccaccctgacagtgtctagtgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatga

SEQ ID NO: 895 - DNA, 1407 bp, Artificial
  antibody sequence
atggcttgggtgtggaccttgctattcctgatggcagctgcccaaagtatacaggcccaggtccagctgcagcagcctggcgctgaactggtcaagccaggcgcttccgtgaagctgagctgcaaggccagcggctacaccttcacccggtactggatgcactgggtcaagcagaggccaggccagggcctggaatggatcggcgagatcaaccccaacaacggccacaccaactacaacgagaagttcgagagccgggccaccctgaccgtggacaagagcagcagcaccgcctacatgcagttcaacagcctgaccagcgaggacagcgccgtgtactactgcggcagactggatggccacctgtacgccgtggattactggggccagggcaccagcgtgaccgtgtcatctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatga

SEQ ID NO: 896 - DNA, 1407 bp, Artificial
  antibody sequence
atggcttgggtgtggaccttgctattcctgatggcagctgcccaaagtatacaggcccaggtccagctgcagcagcctggcacagagctgaagatgcccggcaccagcgtgaagctgagctgcaaggccagcggctacaccttcaccacctactggatgcactgggtcaagctgcggccaggccagggctttgagtggatcggcgagatcaaccccagcaacgacggcaccaactacaacgagaagttcaagcggaaggccaccctgaccgtggacaagcctagcagcaccgcctacatgcagctgtccagcctgaccagcgaggacagcaccatctactactgcaccatcagctactacggctacggcgacttcgactactggggccagggcaccacactgacagtgtcctctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatga

SEQ ID NO: 897 - DNA, 1407 bp, Artificial
  antibody sequence
atggcttgggtgtggaccttgctattcctgatggcagctgcccaaagtatacaggcccaggtgcagctgaaagagtccggccctgatctggtgcagcccagccagaccctgagcctgacctgtaccgtgtccggcttcagcctgaccagctacggcgtgcactgggtccgacagccacctggcaaaggcctggaatgggtcggaaccatgggctggaacgacaagaagtactacaacagcgccctgaagtcccggctgagcatcagcagaaacaccagcaagaaccaggtgttcctgaagctgagcagcctgcagaccgaggacaccgccatgtactactgcaccagggacggcgatagcagcggcagttggttcgcctattggggccagggcaccctggtcaccgtgtctagtgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatga

SEQ ID NO: 898 - DNA, 1401 bp, Artificial
  antibody sequence
atggcttgggtgtggaccttgctattcctgatggcagctgcccaaagtatacaggcccaggtgcagctgaaagagtccggccctgatctggtgcagcccagccagaccctgagcctgacctgtaccgtgtccggcttcagcctgacaggctacgctgtgcattgggtccgacagcctccaggcaagggcgtggaatgggtcggaaccatgggctgggacgacaagaagttctacaacagcgccctgaagtcccggctgagcatctccagggaccccagcaagaaccaggtgttcttcaagctgagcagcctgcagaccgaggacaccgccatgtactactgcaccagggatcacggcgacggcggctttgcctattggggccagggaaccctggtcaccgtgtcctctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatga

SEQ ID NO: 899 - DNA, 1413 bp, Artificial
  antibody sequence
atggcttgggtgtggaccttgctattcctgatggcagctgcccaaagtatacaggccgaagtccagctgcagcagtctggccctgagctggtcaagcctggggccagcgtgaagatcccatgcaaggccagcggctacaccttcaccgactacaacatggactgggtcaagcagagccacggcaagagcctggaatggatcggcaacatcaaccccaacaacggcggcaccatctacaaccagaacttcaaggaccgggccaccctgaccgtggacaagagcagcagcaccgcctacatggaactgcggagcctgaccagcgaggacaccgccgtgtactactgcaccagagagaactccggctacggcggcaactacttcgcctattggggccagggcaccacactgacagtgtcctctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatga

SEQ ID NO: 900 - DNA, 1392 bp, Artificial
  antibody sequence
atggcttgggtgtggaccttgctattcctgatggcagctgcccaaagtatacaggccgaagtccagctgcagcagagcggagccgaactcgtcagacctggcgcttccgtgaagctgagctgcaccaccagcggcttcaacatcaaggacagcctgatctactgggtcaagcagcggcccgagcagggcctggaatggatcggctggattgaccccgaggacggcgagacaaagttcgcccctagattccaggacaaggccaccatcaccagcgacaccagcagcaacaccgcctacctgagactgagcagcctgaccagcgaggacaccgccatctactactgcacccggtccttcggcgtgtgttggggccagggaaccctggtcacagtgtctgctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatga

SEQ ID NO: 901 - DNA, 1392 bp, Artificial; identical to SEQ ID NO: 900
  antibody sequence

SEQ ID NO: 902 - DNA, 1392 bp, Artificial; identical to SEQ ID NO: 900
  antibody sequence

SEQ ID NO: 903 - DNA, 1392 bp, Artificial; identical to SEQ ID NO: 900
  antibody sequence

SEQ ID NO: 904 - DNA, 1392 bp, Artificial; identical to SEQ ID NO: 900
  antibody sequence

SEQ ID NO: 905 - DNA, 1392 bp, Artificial; identical to SEQ ID NO: 900
  antibody sequence

SEQ ID NO: 906 - DNA, 1392 bp, Artificial; identical to SEQ ID NO: 900
  antibody sequence

SEQ ID NO: 907 - DNA, 1392 bp, Artificial; identical to SEQ ID NO: 900
  antibody sequence

SEQ ID NO: 908 - DNA, 1392 bp, Artificial; identical to SEQ ID NO: 900
  antibody sequence

SEQ ID NO: 909 - DNA, 1392 bp, Artificial; identical to SEQ ID NO: 900
  antibody sequence

SEQ ID NO: 910 - DNA, 1392 bp, Artificial; identical to SEQ ID NO: 900
  antibody sequence

SEQ ID NO: 911 - DNA, 1392 bp, Artificial; identical to SEQ ID NO: 900
  antibody sequence

SEQ ID NO: 912 - DNA, 1392 bp, Artificial; identical to SEQ ID NO: 900
  antibody sequence

SEQ ID NO: 913 - DNA, 1392 bp, Artificial; identical to SEQ ID NO: 900
  antibody sequence

SEQ ID NO: 914 - DNA, 1392 bp, Artificial; identical to SEQ ID NO: 900
  antibody sequence

SEQ ID NO: 915 - DNA, 1392 bp, Artificial; identical to SEQ ID NO: 900
  antibody sequence

SEQ ID NO: 916 - DNA, 645 bp, Artificial
  antibody sequence
gatattgtgctaactcagtctccagcaataatggctgcctctctggggcagaaggtcaccatgacctgcagtgccagctcaagtgtaagttccagttacttgcactggtaccagcagaagtcaggcgcttcccccaaacccttgattcataggacatccaacctggcttctggagtcccagctcgcttcagtggcagtgggtctgggacctcttactctctcacaatcagcagcgtggaggctgaagatgatgcaacttattactgccagcagtggagtggttacccattcacgttcggtgctgggaccaagctggagctgaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 917 - DNA, 654 bp, Artificial
  antibody sequence
gacattgtgatgacccagtctccagcttctttggctgtgtctctagggcagagggccaccatctcctgcagagccagcgaaagtgttgataattctggcattagttttatgaactggttccaacagaaaccaggacagccacccaaactcctcatctatgctgcatccaaccaaggatccggggtccctgccaggtttagtggcagtgggtctgggacagacttcagcctcaacatccatcctatggaggaggatgatactgcaatgtatttctgtcagcaaagtaaggaggttccgtacacgttcggaggggggaccaagctggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 918 - DNA, 654 bp, Artificial
  antibody sequence
gatattgtgctaactcagtctccagcttctttggctgtgtctctagggcagagggccaccatctcctgcagagccagcgaaagtgttgataattctggcattagttttatgaactggttccaacagaaaccaggacagccacccaaactcctcatctatgctgcatccaaccaaggatccggggtccctgccaggtttagtggcagtgggtctgggacagacttcagcctcaacatccatcctatggaggaggatgatactgcaatgtatttctgtcagcaaagtaaggaggttccgtacacgttcggaggggggaccaagctggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 919 - DNA, 642 bp, Artificial
  antibody sequence
gatgttgtgatgacccaaactcccaaattcctgcttgtatcagcaggagacagggttaccattacctgcaaggccagtcagagtgtgagtgatgatgtaacttggtaccaacagaagtcaggacagtctcctaaactgctgatatactatgcatccaatcgctacactggagtccctgatcgcttcactggcagtggatatgggacggatttcactttcaccatcagcactgtgcaggctgaagacctggcagtttatttctgtcagcaggattatagctctccgtggacgttcggtggaggcaccaagctggaaatcaaacgggctgatgctgcaccaactgtatccatcttctcaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 920 - DNA, 654 bp, Artificial; identical to SEQ ID NO: 917
  antibody sequence

SEQ ID NO: 921 - DNA, 639 bp, Artificial
  antibody sequence
gatattgtgctaactcagtctccagcaatcatgtctgcatctccaggggagaaggtcaccataacctgcagtgccagctcaagtgtaagttacatgcactggttccagcagaagccaggcacttctcccaaactctggatttatagcacatccaacctggcttctggagtccctgctcgcttcagtggcagtggatctgggacctcttactctctcacaatcagccgaatggaggctgaagatgctgccacttattactgccagcaaaggagtagttacccattcacgttcggctcggggacaaagttggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 922 - DNA, 645 bp, Artificial
  antibody sequence
gacattgtgatgacccagtctccaaccaccatggctgcatctcccggggagaggatcactatcacctgcagtgcccactcaaatttaatttccaattacttacattggtatcagcagaagccaggattctcccctaaactcttgatttataggacatccaatctggcttctggagtcccagctcgcttcagtggcagtgggtctgggacctcttactctctcacaattggcaccatggaggctgaagatgttgccacttacttctgccaacagggtagtagtataccattcacgttcggctcggggacaaagttggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 923 - DNA, 639 bp, Artificial
  antibody sequence
caaattgttctcacccagtctccaacaatcatgtctgcatctccaggggaaaaggtcaccatgacctgcagtgccagctcacatgtaagttacatatactggtaccagcagaagccaggctcctcccccagactctggatttatgacacatccaacctggtttctggagtccctgctcgcttcagtggcagtaggtctgggacctcttattctctcacaatcagcagcatggaggctgaagatgctgccacttattactgccagcagtacagtggttacccgtacacgttcggaggggggaccaagctggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 924 - DNA, 642 bp, Artificial
  antibody sequence
gacatcaagatgacccagagccccagctctatgtacgccagcctgggcgagcgcgtgaccatcacctgtaaagccagccaggacatcaacagctacctgagctggttccagcagaagcccggcaagagccccaagaccctgatctaccgggccaacagactggtggacggcgtgccaagcagattcagcggctctggcagcggccaggactacagccctaccatcagcagcctggaatacgaggacatgggcatctactactgcctgcagtacgacgagttcccctacaccttcggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 925 - DNA, 642 bp, Artificial
  antibody sequence
gacatcgtgatgacccagagccagaaattcatgagcaccagcgtgggcgaccgggtgtccgtgacatgcaaggccagccagaacgtgggcaccaacgtggcctggtatcagcagaagcccggccagagccccaagaccctgatctacagcgccagctacagatacagcggcgtgcccgatagcttcacaggcagcggctctggcaccgacttcaccctgaccatcagcaacgtgcagagcgaggactgggccgagtacttctgccagcagtacaacagctaccccttcaccttcggcagcggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 926 - DNA, 654 bp, Artificial
  antibody sequence
gacatcgtgctgacacagtctccagccagcctggccgtgtctctgggacagagggccaccatgagctgcagagccagcgagtctgtggacggctacggcaacagcttcctgcactggtatcagcagaagcccggccagcctcccaagctgctgatctacagggccagcaacctggaaagcggcatccccgccagattcagcggcaccggcagcagaaccgacttcaccctgaccatcacccctgtggaagccgacgacgtggccacctactactgccagcagagcaacggcgaccccttcaccttcggctccggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 927 - DNA, 657 bp, Artificial
  antibody sequence
gacgtgctgatgacccagacacccctgagcctgcctgtgtctctgggcgatcaggccagcatcagctgccggtctagccagagcatcgtgcacagcaacggcaagacctacctggaatggtatctgcagaagcccggccagagccccaagctgctgatctacaaggtgtccaacagattcagcggcgtgcccgacagattctctggcagcggctctggcaccgacttcaccctgaagatcagccgggtggaagccgaggacctgggcgtgtactactgtctgcagggcagccacgtgccctggacctttggcggcggaacaaagctggaactgaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 928 - DNA, 654 bp, Artificial
  antibody sequence
gacatcgtgctgacacagtctccagccagcctggccgtgtctctgggacagagagccaccatcagctgccgggccagcaagagcgtgtccatcagcggctacagctacatgcactggtatcagcagaagcccggccagcctcccaagctgctgatcgacctggccagcaacctggaaagcggcgtgccagccagattttctggcagcggctccggcaccgacttcaccctgaacatccaccccgtggaagaagaggacgccgccacctactactgccagcacagcagagagctgcccttcaccttcggcagcggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 929 - DNA, 654 bp, Artificial; identical to SEQ ID NO: 926
  antibody sequence

SEQ ID NO: 930 - DNA, 639 bp, Artificial
  antibody sequence
cagatcgtgctgacccagagccctgccatcatgtctgccagccctggcgagaaagtgaccatgacctgtagcgccagcagcagcgtgtcctacatgcactggtatcagcagaagtccggcaccagccccaagcggtggatctacgataccagcaagctggcctccggcgtgccagccagattttctggctctggcagcggcacctcctacagcctgaccatcagcagcatggaagccgaggacgccgccacctactactgccagcagtggatcagcaaccctcccaccttcggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 931 - DNA, 654 bp, Artificial
  antibody sequence
gacatcgtgctgacacagtctccagccagcctggccgtgtccctggaacagagagccaccatcagctgcaaggccagccagagcgtggactacgacggcgacagctacatgaactggtatcagcagaagcccggccagcctcccaagctgctgatctacgccgccagcaacctggaaagcggcatccctgccagattcagcggcagcggctctggcaccgacttcaccctgaacatccaccccgtggaagaagaggacgccgccacctactactgccagcagagcaacgaggaccctctgaccttcggagccggcaccaagctggaactgaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 932 - DNA, 642 bp, Artificial
  antibody sequence
gacatccagatgacccagagccctgccagcctgagcgcctctgtgggcgagacagtgaccaccatctgccgggccagcgagaacatctacagctacctggcctggtatcagcagaagcagggcaagagccctcagctgctggtgtacaacgccaagaccctggtggaaggcgtgcccagcagattttctggctctggcagcggcacccagttcagcctgaagatcaacagcctgcagcccgaggacttcggcagctactactgccagcaccactacggcagcccctacacctttggcggaggcaccaagctggaactgaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 933 - DNA, 657 bp, Artificial
  antibody sequence
gacgtgctgatgacccagacacccctgagcctgcctgtgtctctgggcgatcaggccagcatcagctgccggtctagccagagcatcgtgtacagcaacggcaacacctacctggaatggtatctgcagaagcccggccagagccccaagctgctgatctacaaggtgtccaacagattcagcggcgtgcccgacagattctctggcagcggctctggcaccgacttcaccctgaagatcagccgggtggaagccgaggacctgggcgtgtactactgttttcagggcagccacgtgcccttcaccttcggcagcggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 934 - DNA, 657 bp, Artificial
  antibody sequence
gacgtcgtgatgacccagacccctctgaccctgagcgtgacaatcggccaggccgccagcatcagctgcaagagcagccagagcctgctgcacagcgacggcaagacctacctgaactggctgctgcagaggcctggccagagccccaagagactgatctacctggtgtccaagctggacagcggcgtgcccgatagattcacaggcagcggctccggcaccgacttcaccctgaagatcagccgggtggaagccgaggacctgggcgtgtactactgctggcagggcacccacttcccttacaccttcggcggaggcacaaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 935 - DNA, 657 bp, Artificial
  antibody sequence
gacgtcgtgatgacccagacccctctgaccctgagcgtgacagtgggccagcctgccagcatcagctgcaagagcagccagagcctgctgcacagcgacggcaagacctacctgaactggctgctgcagaggcctggccagagccccaagagactgatctacctggtgtccaagctggacagcggcgtgcccgatagattcacaggcagcggctccggcaccgacttcaccctgaagatcagccgggtggaagccgaggacctgggcgtgtactactgttggcagggcacccacttcccttacaccttcggcggaggcacaaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 936 - DNA, 657 bp, Artificial
  antibody sequence
gacgtcgtgatgacccagacccctctgaccctgagcgtgacaatcggccagcctgccagcatcagctgcaagagcagccagagcctgctggacagcgacggcgagacatacctgaactggctgctgcagaggcctggccagagccccaagcggctgatctacatggtgtccaagctggactccggcgtgcccgacagattcacaggcagcggcagcggaaccgacttcaccctgaagatcagcagagtggaagccgaggacctgggcgtgtactactgttggcagggcacccacttccctcagaccttcggcggaggcacaaagctggaactgaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 937 - DNA, 657 bp, Artificial
  antibody sequence
gacgtcgtgatgacccagacccctctgaccctgagcgtgaccaatggccagcctgccagcatcagctgcaagagcagccagagcctgctggacagcgacggcgagacatacctgaactggctgctgcagaggcctggccagagccccaagagactgatctacctggtgtccaagctggactccggcgtgcccgacagattcatcggctctggcagcggcaccgacttcaccctgaagatcagccgggtggaagccgaggacctgggcgtgtacttctgttggcagggcacccacagcccctacacctttggcggcggaacaaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 938 - DNA, 639 bp, Artificial
  antibody sequence
gacatccagatgacccagagccctagcagcctgtctgccagcctgggcggcaaagtgaccatcacatgcaaggccagccaggacatcaacaagtatatcgcctggtatcagcacaagcccggcaagggccccagactgctgatccactacaccagcaccctgcagcccggcatccctagcagattttctggcagcggctccggcagagactacagcttcagcatcagcaacctggaacccgaggatatcgccacctactactgcctgcagtacgacaacctgcggaccttcggcggaggcaccaaggtggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 939 - DNA, 657 bp, Artificial
  antibody sequence
gacgtgctgatgacccagacacccctgagcctgcctgtgtctctgggcgatcaggccagcatcagctgccggtctagccagagcatcgtgcacagcaacggcaacacctacctggaatggtatctgcagaagcccggccagagccccaagctgctgatctacaaggtgtccaacagattcagcggcgtgcccgacagattctctggcagcggctctggcaccgacttcaccctgaagatcagccgggtggaagccgaggacctgggcgtgtactactgttttcagggcagccacgtgcccttcaccttcggcagcggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 940 - DNA, 639 bp, Artificial
  antibody sequence
cagatcgtgctgacccagagccctgccatcatgtctgccagccctggcgagaaagtgaccatgacctgtagcgccagcagcagcgtgtcctacatgtactggtatcagcagaagcccggcagcagccccagactgctgatctacgacaccagcaacctggccagcggcgtgccagtgcggttttctggcagcggcagcggaaccagctacagcctgaccatcagccggatggaagccgaggacgccgccacctactactgccagcagtggtccagctaccctcccacctttggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 941 - DNA, 654 bp, Artificial; identical to SEQ ID NO: 926
  antibody sequence

SEQ ID NO: 942 - DNA, 642 bp, Artificial
  antibody sequence
aacatcgtgatgacccagagccccaagagcatgagcatgtccgtgggcgagagagtgaccctgagctgcaaggccagcgagaacgtgggcacctacgtgtcctggtatcagcagaagcccgagcagagccctaagctgctgatctacggggccagcaacagatacaccggcgtgcccgagagattcacaggcagcggcagcgccaccgacttcaccctgacaatcagcagcgtgcaggccgaggacctggccgattaccactgtggccagagctacagctaccctctgaccttcggagccggcaccaagctggaactgaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 943 - DNA, 642 bp, Artificial
  antibody sequence
gacatcaagatgacccagagccccagctctatgtacgccagcctgggcgagcgcgtgaccatcacctgtaaagccagccaggacatcaacagctacctgagctggttccagcagaagcccggcaagagccccaagaccctgatctaccgggccaacagactggtggacggcgtgccaagcagattcagcggctctggcagcggccaggactacagcctgaccatcagcagcctggaatacgaggacatgggcatctactactgcctgcagtacgacgagttccctctgaccttcggagccggcaccaagctggaactgaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 944 - DNA, 639 bp, Artificial
  antibody sequence
gacatccagatgacccagagccctagcagcctgtctgccagcctgggcggcaaagtgaccatcacatgcaaggccagccaggacatcaacaagtatatcgcctggtatcagcacaagcccggcaagggccccagactgctgatccactacaccagcaccctgcagcccggcatccctagcagattttctggcagcggctccggcagagactacagcttcagcatcagcaacctggaacccgaggatatcgccacctactactgcctgcagtacgacaacctgtggaccttcggcggaggcaccaaggtggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 945 - DNA, 642 bp, Artificial
  antibody sequence
gacatccagatgacccagagccctgccagcctgagcgcctctgtgggcgagacagtgaccatcatctgccgggccagcgagaacatctacagcaacctggcctggtatcagcagaagcagggcaagagccctcagctgctggtgtacgccgccaccaatctggccgacggcatgcctagcagattcagcggctctggcagcggcacccagtacagcctgaagatcaacagcctgcagagcgaggacttcggcagctactactgccagcacttctggggcaccccttggacctttggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 946 - DNA, 642 bp, Artificial
  antibody sequence
gacatccagatgacccagagccctgccagcctgagcgcctctgtgggcgagacagtgaccatcatctgccgggccagcgagaacatctacagctacctggcctggtatcagcagaagcagggcaagagccctcagctgctgttctacaacgccaagaccctggtggaaggcgtgcccagcagattttctggctctggcagcggcacccagttcagcctgaagatcaacagcctgcagcccgaggacttcggcagctactactgccagcaccactacggcagcccctacacctttggcggaggcaccaagctggaactgaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 947 - DNA, 642 bp, Artificial
  antibody sequence
gacatccagatgacccagagccctagcacactgagcgccagcctgggcgacaccatcaccatcacatgccacgccagccagaacatcaacgtgtggctgagctggtatcagcagaagcccggcaacatccccaagctgctgatctacaaggccagcaacctgcacaccggcgtgcccagcagattttctggcagcggctctggcaccggcttcaccctgacaatcagcagcctgcagcccgaggatatcgccacctactactgccagcagggccagagctaccctctgacctttggcgctggcaccaaggtggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 948 - DNA, 642 bp, Artificial
  antibody sequence
gacatccagatgacccagagccctagcacactgagcgccagcctgggcgacaccatcaccatcacatgccacgccagccagaacatcaacgtgtggctgagctggtatcagcagaagcccggcaacatccccaagctgctgatctacaaggccagcaacctgcacaccggcgtgcccagcagattttctggcagcggctctggcaccggcttcaccctgacaatcagcagcctgcagcccgaggatatcgccacctactactgccagcagggccagagctacccctacacctttggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 949 - DNA, 645 bp, Artificial
  antibody sequence
gagatcgtgctgacccagagccctaccacaatggccgccagccctggcgagaagatcaccatcacatgcagcgccagcagcagcatcagcagcaactacctgcactggtatcagcagaagcccggcttcagccccaagctgctgatctacagaaccagcaacctggccagcggcgtgccagccagattttctggcagcggctctggcaccagctacagcctgaccatcggcaccatggaagccgaggacgtggccacctactactgccagcagggcagctccatccccagaacctttggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 950 - DNA, 654 bp, Artificial
  antibody sequence
gacatcgtgctgacacagtctccagccagcctggccgtgtctctgggacagagagccaccatcagctgcaaggccagccagagcgtggactacgacggcgacagctacatgaactggtatcagcagaagcccggccagcctcccaagctgctgatctacgccgccagcaacctggaaagcggcatccctgccagattcagcggcagcggctctggcaccgacttcaccctgaacatccaccccgtggaagaagaggacgccgccacctactactgccagcagagcaacgaggacccctacaccttcggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 951 - DNA, 654 bp, Artificial
  antibody sequence
gacatcgtgctgacacagtctccagccagcctggccgtgtctctgggacagagagccagcatcagctgcaaggccagccagagcgtggactacgacggcgacagctacatgaactggtatcagcagaagcccggccagcctcccaagctgctgatctacgccgccagcaacctggaaagcggcatccctgccagattcagcggcagcggctctggcaccgacttcaccctgaacatccaccccgtggaagaagaggacgccgccacctactactgccagcagagctacgaggaccccttcaccttcggctccggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 952 - DNA, 639 bp, Artificial; identical to SEQ ID NO: 940
  antibody sequence

SEQ ID NO: 953 - DNA, 642 bp, Artificial
  antibody sequence
gacatcgtgatgacccagagccagaaattcatgagcaccagcgtgggcgaccgggtgtccgtgacatgcaaggccagccagaacgtgggcaccaacgtggcctggtatcagcagaagcccggccagagccccaaggccctgatctacagcgccagctacagatacagcggcgtgcccgacagattcacaggcagcggctctggcaccgacttcaccctgaccatcagcaacgtgcagagcgaggacctggccgagtacttctgccagcagtacaacagctaccccttcaccttcggcagcggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 954 - DNA, 660 bp, Artificial
  antibody sequence
gacatcgtgatgagccagagccctagcagcctggccgtgtccgtgggcgagaaagtgaccatgagctgcaagagcagccagtccctgctgtactccagcaaccagaagaactacctggcctggtatcagcagaagcccggccagtcccctaagctgctgatctactgggccagcaccagagaaagcggcgtgcccgatagattcacaggcagcggctccggcaccgacttcaccctgacaatcagcagcgtgaaggccgaggacctggctgtgtactactgccagcagtactacagctacccctacaccttcggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 955 - DNA, 660 bp, Artificial
  antibody sequence
gacgtcgtgatgacccagacacccctgagcctgcctgtgtctctgggcgatcaggccagcatcagctgcagatccagccagagcctggtgcacagcaacggcaacacctacctgcactggtatctgcagaagcccggccagagccccaagctgctgatctacaaggtgtccaacagattcagcggcgtgcccgacagattctctggcagcggctctggcaccgacttcaccctgaagatcagccgggtggaagccgaggacctgggcgtgtacttctgcagccagtccacccacgtgccaccctacacctttggcggaggcaccaagctggaactgaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 956 - DNA, 657 bp, Artificial
  antibody sequence
gacgtcgtgatgacccagacccctctgaccctgagcgtgacaatcggccagcctgccagcatcagctgcaagagcagccagagcctgctgtactccaacggcaagacctacctgaactggctgctgcagaggcctggccagagccccaagagactgatctacctggtgtccaagctggacagcggcgtgcccgatagattcacaggcagcggctccggcaccgacttcaccctgaagatcagccgggtggaagccgaggacctgggcgtgttctactgtgtgcagggcacccacttccctcagaccttcggcggaggcacaaagctggaactgaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 957 - DNA, 708 bp, Artificial
  antibody sequence
atggagacacattctcaggtctttgtatacatgttgctgtggttgtctggtgtcgagggcgatattgtgctaactcagtctccagcaataatggctgcctctctggggcagaaggtcaccatgacctgcagtgccagctcaagtgtaagttccagttacttgcactggtaccagcagaagtcaggcgcttcccccaaacccttgattcataggacatccaacctggcttctggagtcccagctcgcttcagtggcagtgggtctgggacctcttactctctcacaatcagcagcgtggaggctgaagatgatgcaacttattactgccagcagtggagtggttacccattcacgttcggtgctgggaccaagctggagctgaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 958 - DNA, 717 bp, Artificial
  antibody sequence
atggagacacattctcaggtctttgtatacatgttgctgtggttgtctggtgtcgagggcgacattgtgatgacccagtctccagcttctttggctgtgtctctagggcagagggccaccatctcctgcagagccagcgaaagtgttgataattctggcattagttttatgaactggttccaacagaaaccaggacagccacccaaactcctcatctatgctgcatccaaccaaggatccggggtccctgccaggtttagtggcagtgggtctgggacagacttcagcctcaacatccatcctatggaggaggatgatactgcaatgtatttctgtcagcaaagtaaggaggttccgtacacgttcggaggggggaccaagctggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 959 - DNA, 717 bp, Artificial
  antibody sequence
atggagacacattctcaggtctttgtatacatgttgctgtggttgtctggtgtcgagggcgatattgtgctaactcagtctccagcttctttggctgtgtctctagggcagagggccaccatctcctgcagagccagcgaaagtgttgataattctggcattagttttatgaactggttccaacagaaaccaggacagccacccaaactcctcatctatgctgcatccaaccaaggatccggggtccctgccaggtttagtggcagtgggtctgggacagacttcagcctcaacatccatcctatggaggaggatgatactgcaatgtatttctgtcagcaaagtaaggaggttccgtacacgttcggaggggggaccaagctggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 960 - DNA, 705 bp, Artificial
  antibody sequence
atggagacacattctcaggtctttgtatacatgttgctgtggttgtctggtgtcgagggcgatgttgtgatgacccaaactcccaaattcctgcttgtatcagcaggagacagggttaccattacctgcaaggccagtcagagtgtgagtgatgatgtaacttggtaccaacagaagtcaggacagtctcctaaactgctgatatactatgcatccaatcgctacactggagtccctgatcgcttcactggcagtggatatgggacggatttcactttcaccatcagcactgtgcaggctgaagacctggcagtttatttctgtcagcaggattatagctctccgtggacgttcggtggaggcaccaagctggaaatcaaacgggctgatgctgcaccaactgtatccatcttctcaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 961 - DNA, 717 bp, Artificial; identical to SEQ ID NO: 958
  antibody sequence

SEQ ID NO: 962 - DNA, 702 bp, Artificial
  antibody sequence
atggagacacattctcaggtctttgtatacatgttgctgtggttgtctggtgtcgagggcgatattgtgctaactcagtctccagcaatcatgtctgcatctccaggggagaaggtcaccataacctgcagtgccagctcaagtgtaagttacatgcactggttccagcagaagccaggcacttctcccaaactctggatttatagcacatccaacctggcttctggagtccctgctcgcttcagtggcagtggatctgggacctcttactctctcacaatcagccgaatggaggctgaagatgctgccacttattactgccagcaaaggagtagttacccattcacgttcggctcggggacaaagttggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 963 - DNA, 708 bp, Artificial
  antibody sequence
atggagacacattctcaggtctttgtatacatgttgctgtggttgtctggtgtcgagggcgacattgtgatgacccagtctccaaccaccatggctgcatctcccggggagaggatcactatcacctgcagtgcccactcaaatttaatttccaattacttacattggtatcagcagaagccaggattctcccctaaactcttgatttataggacatccaatctggcttctggagtcccagctcgcttcagtggcagtgggtctgggacctcttactctctcacaattggcaccatggaggctgaagatgttgccacttacttctgccaacagggtagtagtataccattcacgttcggctcggggacaaagttggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 964 - DNA, 702 bp, Artificial
  antibody sequence
atggagacacattctcaggtctttgtatacatgttgctgtggttgtctggtgtcgagggccaaattgttctcacccagtctccaacaatcatgtctgcatctccaggggaaaaggtcaccatgacctgcagtgccagctcacatgtaagttacatatactggtaccagcagaagccaggctcctcccccagactctggatttatgacacatccaacctggtttctggagtccctgctcgcttcagtggcagtaggtctgggacctcttattctctcacaatcagcagcatggaggctgaagatgctgccacttattactgccagcagtacagtggttacccgtacacgttcggaggggggaccaagctggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 965 - DNA, 705 bp, Artificial
  antibody sequence
atggagacacattctcaggtctttgtatacatgttgctgtggttgtctggtgtcgagggcgacatcaagatgacccagagccccagctctatgtacgccagcctgggcgagcgcgtgaccatcacctgtaaagccagccaggacatcaacagctacctgagctggttccagcagaagcccggcaagagccccaagaccctgatctaccgggccaacagactggtggacggcgtgccaagcagattcagcggctctggcagcggccaggactacagccctaccatcagcagcctggaatacgaggacatgggcatctactactgcctgcagtacgacgagttcccctacaccttcggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 966 - DNA, 705 bp, Artificial
  antibody sequence
atggagacacattctcaggtctttgtatacatgttgctgtggttgtctggtgtcgagggcgacatcgtgatgacccagagccagaaattcatgagcaccagcgtgggcgaccgggtgtccgtgacatgcaaggccagccagaacgtgggcaccaacgtggcctggtatcagcagaagcccggccagagccccaagaccctgatctacagcgccagctacagatacagcggcgtgcccgatagcttcacaggcagcggctctggcaccgacttcaccctgaccatcagcaacgtgcagagcgaggactgggccgagtacttctgccagcagtacaacagctaccccttcaccttcggcagcggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 967 - DNA, 717 bp, Artificial
  antibody sequence
atggagacacattctcaggtctttgtatacatgttgctgtggttgtctggtgtcgagggcgacatcgtgctgacacagtctccagccagcctggccgtgtctctgggacagagggccaccatgagctgcagagccagcgagtctgtggacggctacggcaacagcttcctgcactggtatcagcagaagcccggccagcctcccaagctgctgatctacagggccagcaacctggaaagcggcatccccgccagattcagcggcaccggcagcagaaccgacttcaccctgaccatcacccctgtggaagccgacgacgtggccacctactactgccagcagagcaacggcgaccccttcaccttcggctccggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 968 - DNA, 720 bp, Artificial
  antibody sequence
atggagacacattctcaggtctttgtatacatgttgctgtggttgtctggtgtcgagggcgacgtgctgatgacccagacacccctgagcctgcctgtgtctctgggcgatcaggccagcatcagctgccggtctagccagagcatcgtgcacagcaacggcaagacctacctggaatggtatctgcagaagcccggccagagccccaagctgctgatctacaaggtgtccaacagattcagcggcgtgcccgacagattctctggcagcggctctggcaccgacttcaccctgaagatcagccgggtggaagccgaggacctgggcgtgtactactgtctgcagggcagccacgtgccctggacctttggcggcggaacaaagctggaactgaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 969 - DNA, 717 bp, Artificial
  antibody sequence
atggagacacattctcaggtctttgtatacatgttgctgtggttgtctggtgtcgagggcgacatcgtgctgacacagtctccagccagcctggccgtgtctctgggacagagagccaccatcagctgccgggccagcaagagcgtgtccatcagcggctacagctacatgcactggtatcagcagaagcccggccagcctcccaagctgctgatcgacctggccagcaacctggaaagcggcgtgccagccagattttctggcagcggctccggcaccgacttcaccctgaacatccaccccgtggaagaagaggacgccgccacctactactgccagcacagcagagagctgcccttcaccttcggcagcggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 970 - DNA, 717 bp, Artificial; identical to SEQ ID NO: 967
  antibody sequence

SEQ ID NO: 971 - DNA, 702 bp, Artificial
  antibody sequence
atggagacacattctcaggtctttgtatacatgttgctgtggttgtctggtgtcgagggccagatcgtgctgacccagagccctgccatcatgtctgccagccctggcgagaaagtgaccatgacctgtagcgccagcagcagcgtgtcctacatgcactggtatcagcagaagtccggcaccagccccaagcggtggatctacgataccagcaagctggcctccggcgtgccagccagattttctggctctggcagcggcacctcctacagcctgaccatcagcagcatggaagccgaggacgccgccacctactactgccagcagtggatcagcaaccctcccaccttcggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 972 - DNA, 717 bp, Artificial
  antibody sequence
atggagacacattctcaggtctttgtatacatgttgctgtggttgtctggtgtcgagggcgacatcgtgctgacacagtctccagccagcctggccgtgtccctggaacagagagccaccatcagctgcaaggccagccagagcgtggactacgacggcgacagctacatgaactggtatcagcagaagcccggccagcctcccaagctgctgatctacgccgccagcaacctggaaagcggcatccctgccagattcagcggcagcggctctggcaccgacttcaccctgaacatccaccccgtggaagaagaggacgccgccacctactactgccagcagagcaacgaggaccctctgaccttcggagccggcaccaagctggaactgaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 973 - DNA, 705 bp, Artificial
  antibody sequence
atggagacacattctcaggtctttgtatacatgttgctgtggttgtctggtgtcgagggcgacatccagatgacccagagccctgccagcctgagcgcctctgtgggcgagacagtgaccaccatctgccgggccagcgagaacatctacagctacctggcctggtatcagcagaagcagggcaagagccctcagctgctggtgtacaacgccaagaccctggtggaaggcgtgcccagcagattttctggctctggcagcggcacccagttcagcctgaagatcaacagcctgcagcccgaggacttcggcagctactactgccagcaccactacggcagcccctacacctttggcggaggcaccaagctggaactgaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 974 - DNA, 720 bp, Artificial
  antibody sequence
atggagacacattctcaggtctttgtatacatgttgctgtggttgtctggtgtcgagggcgacgtgctgatgacccagacacccctgagcctgcctgtgtctctgggcgatcaggccagcatcagctgccggtctagccagagcatcgtgtacagcaacggcaacacctacctggaatggtatctgcagaagcccggccagagccccaagctgctgatctacaaggtgtccaacagattcagcggcgtgcccgacagattctctggcagcggctctggcaccgacttcaccctgaagatcagccgggtggaagccgaggacctgggcgtgtactactgttttcagggcagccacgtgcccttcaccttcggcagcggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 975 - DNA, 720 bp, Artificial
  antibody sequence
atggagacacattctcaggtctttgtatacatgttgctgtggttgtctggtgtcgagggcgacgtcgtgatgacccagacccctctgaccctgagcgtgacaatcggccaggccgccagcatcagctgcaagagcagccagagcctgctgcacagcgacggcaagacctacctgaactggctgctgcagaggcctggccagagccccaagagactgatctacctggtgtccaagctggacagcggcgtgcccgatagattcacaggcagcggctccggcaccgacttcaccctgaagatcagccgggtggaagccgaggacctgggcgtgtactactgctggcagggcacccacttcccttacaccttcggcggaggcacaaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 976 - DNA, 720 bp, Artificial
  antibody sequence
atggagacacattctcaggtctttgtatacatgttgctgtggttgtctggtgtcgagggcgacgtcgtgatgacccagacccctctgaccctgagcgtgacagtgggccagcctgccagcatcagctgcaagagcagccagagcctgctgcacagcgacggcaagacctacctgaactggctgctgcagaggcctggccagagccccaagagactgatctacctggtgtccaagctggacagcggcgtgcccgatagattcacaggcagcggctccggcaccgacttcaccctgaagatcagccgggtggaagccgaggacctgggcgtgtactactgttggcagggcacccacttcccttacaccttcggcggaggcacaaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 977 - DNA, 720 bp, Artificial
  antibody sequence
atggagacacattctcaggtctttgtatacatgttgctgtggttgtctggtgtcgagggcgacgtcgtgatgacccagacccctctgaccctgagcgtgacaatcggccagcctgccagcatcagctgcaagagcagccagagcctgctggacagcgacggcgagacatacctgaactggctgctgcagaggcctggccagagccccaagcggctgatctacatggtgtccaagctggactccggcgtgcccgacagattcacaggcagcggcagcggaaccgacttcaccctgaagatcagcagagtggaagccgaggacctgggcgtgtactactgttggcagggcacccacttccctcagaccttcggcggaggcacaaagctggaactgaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 978 - DNA, 720 bp, Artificial
  antibody sequence
atggagacacattctcaggtctttgtatacatgttgctgtggttgtctggtgtcgagggcgacgtcgtgatgacccagacccctctgaccctgagcgtgaccaatggccagcctgccagcatcagctgcaagagcagccagagcctgctggacagcgacggcgagacatacctgaactggctgctgcagaggcctggccagagccccaagagactgatctacctggtgtccaagctggactccggcgtgcccgacagattcatcggctctggcagcggcaccgacttcaccctgaagatcagccgggtggaagccgaggacctgggcgtgtacttctgttggcagggcacccacagcccctacacctttggcggcggaacaaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 979 - DNA, 702 bp, Artificial
  antibody sequence
atggagacacattctcaggtctttgtatacatgttgctgtggttgtctggtgtcgagggcgacatccagatgacccagagccctagcagcctgtctgccagcctgggcggcaaagtgaccatcacatgcaaggccagccaggacatcaacaagtatatcgcctggtatcagcacaagcccggcaagggccccagactgctgatccactacaccagcaccctgcagcccggcatccctagcagattttctggcagcggctccggcagagactacagcttcagcatcagcaacctggaacccgaggatatcgccacctactactgcctgcagtacgacaacctgcggaccttcggcggaggcaccaaggtggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 980 - DNA, 720 bp, Artificial
  antibody sequence
atggagacacattctcaggtctttgtatacatgttgctgtggttgtctggtgtcgagggcgacgtgctgatgacccagacacccctgagcctgcctgtgtctctgggcgatcaggccagcatcagctgccggtctagccagagcatcgtgcacagcaacggcaacacctacctggaatggtatctgcagaagcccggccagagccccaagctgctgatctacaaggtgtccaacagattcagcggcgtgcccgacagattctctggcagcggctctggcaccgacttcaccctgaagatcagccgggtggaagccgaggacctgggcgtgtactactgttttcagggcagccacgtgcccttcaccttcggcagcggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 981 - DNA, 702 bp, Artificial
  antibody sequence
atggagacacattctcaggtctttgtatacatgttgctgtggttgtctggtgtcgagggccagatcgtgctgacccagagccctgccatcatgtctgccagccctggcgagaaagtgaccatgacctgtagcgccagcagcagcgtgtcctacatgtactggtatcagcagaagcccggcagcagccccagactgctgatctacgacaccagcaacctggccagcggcgtgccagtgcggttttctggcagcggcagcggaaccagctacagcctgaccatcagccggatggaagccgaggacgccgccacctactactgccagcagtggtccagctaccctcccacctttggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 982 - DNA, 717 bp, Artificial; identical to SEQ ID NO: 967
  antibody sequence

SEQ ID NO: 983 - DNA, 705 bp, Artificial
  antibody sequence
atggagacacattctcaggtctttgtatacatgttgctgtggttgtctggtgtcgagggcaacatcgtgatgacccagagccccaagagcatgagcatgtccgtgggcgagagagtgaccctgagctgcaaggccagcgagaacgtgggcacctacgtgtcctggtatcagcagaagcccgagcagagccctaagctgctgatctacggggccagcaacagatacaccggcgtgcccgagagattcacaggcagcggcagcgccaccgacttcaccctgacaatcagcagcgtgcaggccgaggacctggccgattaccactgtggccagagctacagctaccctctgaccttcggagccggcaccaagctggaactgaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 984 - DNA, 705 bp, Artificial
  antibody sequence
atggagacacattctcaggtctttgtatacatgttgctgtggttgtctggtgtcgagggcgacatcaagatgacccagagccccagctctatgtacgccagcctgggcgagcgcgtgaccatcacctgtaaagccagccaggacatcaacagctacctgagctggttccagcagaagcccggcaagagccccaagaccctgatctaccgggccaacagactggtggacggcgtgccaagcagattcagcggctctggcagcggccaggactacagcctgaccatcagcagcctggaatacgaggacatgggcatctactactgcctgcagtacgacgagttccctctgaccttcggagccggcaccaagctggaactgaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 985 - DNA, 702 bp, Artificial
  antibody sequence
atggagacacattctcaggtctttgtatacatgttgctgtggttgtctggtgtcgagggcgacatccagatgacccagagccctagcagcctgtctgccagcctgggcggcaaagtgaccatcacatgcaaggccagccaggacatcaacaagtatatcgcctggtatcagcacaagcccggcaagggccccagactgctgatccactacaccagcaccctgcagcccggcatccctagcagattttctggcagcggctccggcagagactacagcttcagcatcagcaacctggaacccgaggatatcgccacctactactgcctgcagtacgacaacctgtggaccttcggcggaggcaccaaggtggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 986 - DNA, 705 bp, Artificial
  antibody sequence
atggagacacattctcaggtctttgtatacatgttgctgtggttgtctggtgtcgagggcgacatccagatgacccagagccctgccagcctgagcgcctctgtgggcgagacagtgaccatcatctgccgggccagcgagaacatctacagcaacctggcctggtatcagcagaagcagggcaagagccctcagctgctggtgtacgccgccaccaatctggccgacggcatgcctagcagattcagcggctctggcagcggcacccagtacagcctgaagatcaacagcctgcagagcgaggacttcggcagctactactgccagcacttctggggcaccccttggacctttggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 987 - DNA, 705 bp, Artificial
  antibody sequence
atggagacacattctcaggtctttgtatacatgttgctgtggttgtctggtgtcgagggcgacatccagatgacccagagccctgccagcctgagcgcctctgtgggcgagacagtgaccatcatctgccgggccagcgagaacatctacagctacctggcctggtatcagcagaagcagggcaagagccctcagctgctgttctacaacgccaagaccctggtggaaggcgtgcccagcagattttctggctctggcagcggcacccagttcagcctgaagatcaacagcctgcagcccgaggacttcggcagctactactgccagcaccactacggcagcccctacacctttggcggaggcaccaagctggaactgaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 988 - DNA, 705 bp, Artificial
  antibody sequence
atggagacacattctcaggtctttgtatacatgttgctgtggttgtctggtgtcgagggcgacatccagatgacccagagccctagcacactgagcgccagcctgggcgacaccatcaccatcacatgccacgccagccagaacatcaacgtgtggctgagctggtatcagcagaagcccggcaacatccccaagctgctgatctacaaggccagcaacctgcacaccggcgtgcccagcagattttctggcagcggctctggcaccggcttcaccctgacaatcagcagcctgcagcccgaggatatcgccacctactactgccagcagggccagagctaccctctgacctttggcgctggcaccaaggtggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 989 - DNA, 705 bp, Artificial
  antibody sequence
atggagacacattctcaggtctttgtatacatgttgctgtggttgtctggtgtcgagggcgacatccagatgacccagagccctagcacactgagcgccagcctgggcgacaccatcaccatcacatgccacgccagccagaacatcaacgtgtggctgagctggtatcagcagaagcccggcaacatccccaagctgctgatctacaaggccagcaacctgcacaccggcgtgcccagcagattttctggcagcggctctggcaccggcttcaccctgacaatcagcagcctgcagcccgaggatatcgccacctactactgccagcagggccagagctacccctacacctttggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 990 - DNA, 708 bp, Artificial
  antibody sequence
atggagacacattctcaggtctttgtatacatgttgctgtggttgtctggtgtcgagggcgagatcgtgctgacccagagccctaccacaatggccgccagccctggcgagaagatcaccatcacatgcagcgccagcagcagcatcagcagcaactacctgcactggtatcagcagaagcccggcttcagccccaagctgctgatctacagaaccagcaacctggccagcggcgtgccagccagattttctggcagcggctctggcaccagctacagcctgaccatcggcaccatggaagccgaggacgtggccacctactactgccagcagggcagctccatccccagaacctttggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 991 - DNA, 717 bp, Artificial
  antibody sequence
atggagacacattctcaggtctttgtatacatgttgctgtggttgtctggtgtcgagggcgacatcgtgctgacacagtctccagccagcctggccgtgtctctgggacagagagccaccatcagctgcaaggccagccagagcgtggactacgacggcgacagctacatgaactggtatcagcagaagcccggccagcctcccaagctgctgatctacgccgccagcaacctggaaagcggcatccctgccagattcagcggcagcggctctggcaccgacttcaccctgaacatccaccccgtggaagaagaggacgccgccacctactactgccagcagagcaacgaggacccctacaccttcggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 992 - DNA, 717 bp, Artificial
  antibody sequence
atggagacacattctcaggtctttgtatacatgttgctgtggttgtctggtgtcgagggcgacatcgtgctgacacagtctccagccagcctggccgtgtctctgggacagagagccagcatcagctgcaaggccagccagagcgtggactacgacggcgacagctacatgaactggtatcagcagaagcccggccagcctcccaagctgctgatctacgccgccagcaacctggaaagcggcatccctgccagattcagcggcagcggctctggcaccgacttcaccctgaacatccaccccgtggaagaagaggacgccgccacctactactgccagcagagctacgaggaccccttcaccttcggctccggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 993 - DNA, 702 bp, Artificial; identical to SEQ ID NO: 981
  antibody sequence

SEQ ID NO: 994 - DNA, 705 bp, Artificial
  antibody sequence
atggagacacattctcaggtctttgtatacatgttgctgtggttgtctggtgtcgagggcgacatcgtgatgacccagagccagaaattcatgagcaccagcgtgggcgaccgggtgtccgtgacatgcaaggccagccagaacgtgggcaccaacgtggcctggtatcagcagaagcccggccagagccccaaggccctgatctacagcgccagctacagatacagcggcgtgcccgacagattcacaggcagcggctctggcaccgacttcaccctgaccatcagcaacgtgcagagcgaggacctggccgagtacttctgccagcagtacaacagctaccccttcaccttcggcagcggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 995 - DNA, 723 bp, Artificial
  antibody sequence
atggagacacattctcaggtctttgtatacatgttgctgtggttgtctggtgtcgagggcgacatcgtgatgagccagagccctagcagcctggccgtgtccgtgggcgagaaagtgaccatgagctgcaagagcagccagtccctgctgtactccagcaaccagaagaactacctggcctggtatcagcagaagcccggccagtcccctaagctgctgatctactgggccagcaccagagaaagcggcgtgcccgatagattcacaggcagcggctccggcaccgacttcaccctgacaatcagcagcgtgaaggccgaggacctggctgtgtactactgccagcagtactacagctacccctacaccttcggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 996 - DNA, 723 bp, Artificial
  antibody sequence
atggagacacattctcaggtctttgtatacatgttgctgtggttgtctggtgtcgagggcgacgtcgtgatgacccagacacccctgagcctgcctgtgtctctgggcgatcaggccagcatcagctgcagatccagccagagcctggtgcacagcaacggcaacacctacctgcactggtatctgcagaagcccggccagagccccaagctgctgatctacaaggtgtccaacagattcagcggcgtgcccgacagattctctggcagcggctctggcaccgacttcaccctgaagatcagccgggtggaagccgaggacctgggcgtgtacttctgcagccagtccacccacgtgccaccctacacctttggcggaggcaccaagctggaactgaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 997 - DNA, 720 bp, Artificial
  antibody sequence
atggagacacattctcaggtctttgtatacatgttgctgtggttgtctggtgtcgagggcgacgtcgtgatgacccagacccctctgaccctgagcgtgacaatcggccagcctgccagcatcagctgcaagagcagccagagcctgctgtactccaacggcaagacctacctgaactggctgctgcagaggcctggccagagccccaagagactgatctacctggtgtccaagctggacagcggcgtgcccgatagattcacaggcagcggctccggcaccgacttcaccctgaagatcagccgggtggaagccgaggacctgggcgtgttctactgtgtgcagggcacccacttccctcagaccttcggcggaggcacaaagctggaactgaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 998 - DNA, 1338 bp, Artificial
  antibody sequence
gaggttcagctgcagcagtctgggggaggctcagtgcagcctggagggtcccggaaactctcctgtgcagcctctggattcaccttcagtagttttggaatgcactgggttcgtcaggctccagagaaggggctggagtgggtcgcatacattagtagtggcagtagtttcatctactatggagacacagtgaagggccgattcaccatctccagagacaatcccaataacaccctgttcctgcaaatgaccagtctaaggtctgaggacacggccatatattactgtgcaagagaaggaatttatttctacgatagtaggtacttcgatgtctggggcgcagggaccacggtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctggagtctgacctctacactctgagcagctcagtgactgtcccctccagccctcggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatgaacacgaatggctcttacttcgtctacagcaagctcaatgtgcagaagagcaactgggaggcaggaaatactttcacctgctctgtgttacatgagggcctgcacaaccaccatactgagaagagcctctcccactctcctggtaaa

SEQ ID NO: 999 - DNA, 1338 bp, Artificial; identical to SEQ ID NO: 998
  antibody sequence

SEQ ID NO: 1000 - DNA, 1404 bp, Artificial
  antibody sequence
gatgtacagcttcaggagtcaggacctgggcactccatggtgaccctgggatgcctggttgggcaaagtatacaggccgagttccagctgcagcagtctggacctgaactagtgaagactggggcttcagtgaagatatcctgcaaggcttctggttactctttcactggttactacatgcactgggtcaagcagagccatggaaggagccttgagtggattggatatcttagttgttacagtggtgctactagctacaaccagaagttcaagggcaaggccacatttactgtagacacatcctccaccacagcctacatgcagttcaacagcctgacatctgaagactctgcggtctattactgtgcacgaggggagagctactatgttatggactattggggtcaaggaacctcagtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctggagtctgacctctacactctgagcagctcagtgactgtcccctccagccctcggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatgaacacgaatggctcttacttcgtctacagcaagctcaatgtgcagaagagcaactgggaggcaggaaatactttcacctgctctgtgttacatgagggcctgcacaaccaccatactgagaagagcctctcccactctcctggtaaa

SEQ ID NO: 1001 - DNA, 1341 bp, Artificial
  antibody sequence
gaggttcagctgcagcagtctggacctggcctggtgaagccttctcagacagtgtccctcacctgcactgtcactggctactctatcactaatggtaatcactggtggaactggatccggcaggtttcaggaagcaaactggagtggatagggtacataagctccagtggtagcactgacagcaatccatctctcaaaagtcgaatctccatcactagagacacttccaagaaccagttattcctgcagttgaactctgtgactactgaagatatagccacatattactgtgcaagagggcattactacgatggtagctcctatgctatggactactggggtcaaggaacctcagtcaccgtctcctcagccaaaacaacagccccatcggtctatccactggcccctgtgtgtggagatacaagtgactccatggtgaccctgggatgcctggtcaagggctatttccctgagccagtgacagtgacctggaactctggatccctgtccagcggtgtgcacaccttcccagctgtcctggagtctgacctctacactctgagcagctcagtgactgtcccctccagccctcggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatgaacacgaatggctcttacttcgtctacagcaagctcaatgtgcagaagagcaactgggaggcaggaaatactttcacctgctctgtgttacatgagggcctgcacaaccaccatactgagaagagcctctcccactctcctggtaaa

SEQ ID NO: 1002 - DNA, 1317 bp, Artificial
  antibody sequence
gaggttcagctgcagcagtctggggctgagctggtgaagcctggggcttcagtgaagatgtcctgtaaggcttctggatacacattcactgactactacatggactgggtgaagcagagccatggaaaaagctttgagtggattggacatgttaatccttacaatggtgatactaggtacaaccagaagttcaagggcaaggccacattgactgttgacaagtcctccaccacagcctacatggagctcaacagcctgacatctgaggactctgcggtctattactgtgcaagagggaacttctttgactactggggccaaggcaccactctctcagtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctggagtctgacctctacactctgagcagctcagtgactgtcccctccagccctcggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatgaacacgaatggctcttacttcgtctacagcaagctcaatgtgcagaagagcaactgggaggcaggaaatactttcacctgctctgtgttacatgagggcctgcacaaccaccatactgagaagagcctctcccactctcctggtaaa

SEQ ID NO: 1003 - DNA, 1323 bp, Artificial
  antibody sequence
gaggttcagctgcagcagtctggggctgagctggtgaagcctggggcttcagtgaagatatcctgcaagacttctggttactcatttactggctactttatgaattgggtgatgcagagccatggaaagagccttgagtggattggacgtattaatccttacaatggtgatactttctacaaccagaagttcaagggcaaggccacattgactgtagacaaatcctctagcacagcccacatggagctccggagcctggcatctgaggactctgcagtctattattgtgcaagaagctacggctatgctatggactactggggtcaaggaacctcagtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctggagtctgacctctacactctgagcagctcagtgactgtcccctccagccctcggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatgaacacgaatggctcttacttcgtctacagcaagctcaatgtgcagaagagcaactgggaggcaggaaatactttcacctgctctgtgttacatgagggcctgcacaaccaccatactgagaagagcctctcccactctcctggtaaa

SEQ ID NO: 1004 - DNA, 1329 bp, Artificial
  antibody sequence
caggtgcagctgaaggagtcaggacctggcctggtggcgccctcacagagcctgtccatcacatgcaccgtctcagggttctcattaaccggctatggtgtaaactgggttcgccagcctccaggaaagggtctggagtggctggggttgatgtggggtgatggaagcacagactataattcagctctcaactccagactgcgcatcaacaaggacaactccaagagtcaagttttcttaaaaatgagcagtcttcaaactgatgacacagccatttactactgtgtcagaaagggcggtaatagcccctatgctatggactactggggtcaaggaacctcagtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctggagtctgacctctacactctgagcagctcagtgactgtcccctccagccctcggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatgaacacgaatggctcttacttcgtctacagcaagctcaatgtgcagaagagcaactgggaggcaggaaatactttcacctgctctgtgttacatgagggcctgcacaaccaccatactgagaagagcctctcccactctcctggtaaa

SEQ ID NO: 1005 - DNA, 1329 bp, Artificial; identical to SEQ ID NO: 1004
  antibody sequence

SEQ ID NO: 1006 - DNA, 1323 bp, Artificial
  antibody sequence
gaagtgaagctggtggagtctgggcctgagctggtgaagcctggggcttcagtgaagatatcctgcaagacttctggttactcatttactggctactttatgaattgggtgatgcagagccatggaaagagccttgagtggattggacgtattaatccttacaatggtgatactttctacaaccagaagttcaagggcaaggccacattgactgtagacaaatcctctagcacagcccacatggagctccggagcctggcatctgaggactctgcagtctattattgtgcaagaagctacggctatgctatggactactggggtcaaggaacctcagtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctggagtctgacctctacactctgagcagctcagtgactgtcccctccagccctcggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatgaacacgaatggctcttacttcgtctacagcaagctcaatgtgcagaagagcaactgggaggcaggaaatactttcacctgctctgtgttacatgagggcctgcacaaccaccatactgagaagagcctctcccactctcctggtaaa

SEQ ID NO: 1007 - DNA, 1323 bp, Artificial; identical to SEQ ID NO: 1006
  antibody sequence

SEQ ID NO: 1008 - DNA, 1323 bp, Artificial
  antibody sequence
gaggttcagctgcagcagtctggacctgagctggtgaagcctggggcttcagtgaagatatcctgcaaggcttctggttactcatttactggctactttatgaattgggtgatgcagagccatggaaagagccttgagtggattggacgtattaatccttacaatggtgatactttctacaaccagaaattcaaggccaaggccacattgactgtagacaaatcctctaacacagcccacatggagctccggagcctggcatctgaggactctgcagtctatttttgtgcaagaagttacggctatgctatggactactggggtctaggaacctcagtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctggagtctgacctctacactctgagcagctcagtgactgtcccctccagccctcggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatgaacacgaatggctcttacttcgtctacagcaagctcaatgtgcagaagagcaactgggaggcaggaaatactttcacctgctctgtgttacatgagggcctgcacaaccaccatactgagaagagcctctcccactctcctggtaaa

SEQ ID NO: 1009 - DNA, 1326 bp, Artificial
  antibody sequence
gaggttcagctgcagcagtctgggcctgaactagtgaagactggggcttcagtgaagatatcctgcaaggcttctggttactctttcactggttactacatgcactgggtcaagcagagccatggaaagagccttgagtggattggatatcttagttgttacagtggtgctactagctacaaccagaagttcaagggcaaggccacatttactgtagacacatcctccaccacagcctacatgcagttcaacagcctgacatctgaagactctgcggtctattactgtgcacgaggggagagctactatgttatggactattggggtcaaggaacctcagtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctggagtctgacctctacactctgagcagctcagtgactgtcccctccagccctcggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatgaacacgaatggctcttacttcgtctacagcaagctcaatgtgcagaagagcaactgggaggcaggaaatactttcacctgctctgtgttacatgagggcctgcacaaccaccatactgagaagagcctctcccactctcctggtaaa

SEQ ID NO: 1010 - DNA, 1398 bp, Artificial
  antibody sequence
atggcttgggtgtggaccttgctattcctgatggcagctgcccaaagtatacaggccgaggttcagctgcagcagtctgggggaggctcagtgcagcctggagggtcccggaaactctcctgtgcagcctctggattcaccttcagtagttttggaatgcactgggttcgtcaggctccagagaaggggctggagtgggtcgcatacattagtagtggcagtagtttcatctactatggagacacagtgaagggccgattcaccatctccagagacaatcccaataacaccctgttcctgcaaatgaccagtctaaggtctgaggacacggccatatattactgtgcaagagaaggaatttatttctacgatagtaggtacttcgatgtctggggcgcagggaccacggtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctggagtctgacctctacactctgagcagctcagtgactgtcccctccagccctcggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatgaacacgaatggctcttacttcgtctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 1011 - DNA, 1398 bp, Artificial; identical to SEQ ID NO: 1010
  antibody sequence

SEQ ID NO: 1012 - DNA, 1464 bp, Artificial
  antibody sequence
atggcttgggtgtggaccttgctattcctgatggcagctgcccaaagtatacaggccgatgtacagcttcaggagtcaggacctgggcactccatggtgaccctgggatgcctggttgggcaaagtatacaggccgagttccagctgcagcagtctggacctgaactagtgaagactggggcttcagtgaagatatcctgcaaggcttctggttactctttcactggttactacatgcactgggtcaagcagagccatggaaggagccttgagtggattggatatcttagttgttacagtggtgctactagctacaaccagaagttcaagggcaaggccacatttactgtagacacatcctccaccacagcctacatgcagttcaacagcctgacatctgaagactctgcggtctattactgtgcacgaggggagagctactatgttatggactattggggtcaaggaacctcagtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctggagtctgacctctacactctgagcagctcagtgactgtcccctccagccctcggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatgaacacgaatggctcttacttcgtctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 1013 - DNA, 1401 bp, Artificial
  antibody sequence
atggcttgggtgtggaccttgctattcctgatggcagctgcccaaagtatacaggccgaggttcagctgcagcagtctggacctggcctggtgaagccttctcagacagtgtccctcacctgcactgtcactggctactctatcactaatggtaatcactggtggaactggatccggcaggtttcaggaagcaaactggagtggatagggtacataagctccagtggtagcactgacagcaatccatctctcaaaagtcgaatctccatcactagagacacttccaagaaccagttattcctgcagttgaactctgtgactactgaagatatagccacatattactgtgcaagagggcattactacgatggtagctcctatgctatggactactggggtcaaggaacctcagtcaccgtctcctcagccaaaacaacagccccatcggtctatccactggcccctgtgtgtggagatacaagtgactccatggtgaccctgggatgcctggtcaagggctatttccctgagccagtgacagtgacctggaactctggatccctgtccagcggtgtgcacaccttcccagctgtcctggagtctgacctctacactctgagcagctcagtgactgtcccctccagccctcggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatgaacacgaatggctcttacttcgtctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 1014 - DNA, 1377 bp, Artificial
  antibody sequence
atggcttgggtgtggaccttgctattcctgatggcagctgcccaaagtatacaggccgaggttcagctgcagcagtctggggctgagctggtgaagcctggggcttcagtgaagatgtcctgtaaggcttctggatacacattcactgactactacatggactgggtgaagcagagccatggaaaaagctttgagtggattggacatgttaatccttacaatggtgatactaggtacaaccagaagttcaagggcaaggccacattgactgttgacaagtcctccaccacagcctacatggagctcaacagcctgacatctgaggactctgcggtctattactgtgcaagagggaacttctttgactactggggccaaggcaccactctctcagtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctggagtctgacctctacactctgagcagctcagtgactgtcccctccagccctcggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatgaacacgaatggctcttacttcgtctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 1015 - DNA, 1383 bp, Artificial
  antibody sequence
atggcttgggtgtggaccttgctattcctgatggcagctgcccaaagtatacaggccgaggttcagctgcagcagtctggggctgagctggtgaagcctggggcttcagtgaagatatcctgcaagacttctggttactcatttactggctactttatgaattgggtgatgcagagccatggaaagagccttgagtggattggacgtattaatccttacaatggtgatactttctacaaccagaagttcaagggcaaggccacattgactgtagacaaatcctctagcacagcccacatggagctccggagcctggcatctgaggactctgcagtctattattgtgcaagaagctacggctatgctatggactactggggtcaaggaacctcagtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctggagtctgacctctacactctgagcagctcagtgactgtcccctccagccctcggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatgaacacgaatggctcttacttcgtctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 1016 - DNA, 1389 bp, Artificial
  antibody sequence
atggcttgggtgtggaccttgctattcctgatggcagctgcccaaagtatacaggcccaggtgcagctgaaggagtcaggacctggcctggtggcgccctcacagagcctgtccatcacatgcaccgtctcagggttctcattaaccggctatggtgtaaactgggttcgccagcctccaggaaagggtctggagtggctggggttgatgtggggtgatggaagcacagactataattcagctctcaactccagactgcgcatcaacaaggacaactccaagagtcaagttttcttaaaaatgagcagtcttcaaactgatgacacagccatttactactgtgtcagaaagggcggtaatagcccctatgctatggactactggggtcaaggaacctcagtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctggagtctgacctctacactctgagcagctcagtgactgtcccctccagccctcggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatgaacacgaatggctcttacttcgtctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 1017 - DNA, 1389 bp, Artificial; identical to SEQ ID NO: 1016
  antibody sequence

SEQ ID NO: 1018 - DNA, 1383 bp, Artificial
  antibody sequence
atggcttgggtgtggaccttgctattcctgatggcagctgcccaaagtatacaggccgaagtgaagctggtggagtctgggcctgagctggtgaagcctggggcttcagtgaagatatcctgcaagacttctggttactcatttactggctactttatgaattgggtgatgcagagccatggaaagagccttgagtggattggacgtattaatccttacaatggtgatactttctacaaccagaagttcaagggcaaggccacattgactgtagacaaatcctctagcacagcccacatggagctccggagcctggcatctgaggactctgcagtctattattgtgcaagaagctacggctatgctatggactactggggtcaaggaacctcagtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctggagtctgacctctacactctgagcagctcagtgactgtcccctccagccctcggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatgaacacgaatggctcttacttcgtctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 1019 - DNA, 1383 bp, Artificial; identical to SEQ ID NO: 1018
  antibody sequence

SEQ ID NO: 1020 - DNA, 1383 bp, Artificial
  antibody sequence
atggcttgggtgtggaccttgctattcctgatggcagctgcccaaagtatacaggccgaggttcagctgcagcagtctggacctgagctggtgaagcctggggcttcagtgaagatatcctgcaaggcttctggttactcatttactggctactttatgaattgggtgatgcagagccatggaaagagccttgagtggattggacgtattaatccttacaatggtgatactttctacaaccagaaattcaaggccaaggccacattgactgtagacaaatcctctaacacagcccacatggagctccggagcctggcatctgaggactctgcagtctatttttgtgcaagaagttacggctatgctatggactactggggtctaggaacctcagtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctggagtctgacctctacactctgagcagctcagtgactgtcccctccagccctcggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatgaacacgaatggctcttacttcgtctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 1021 - DNA, 1386 bp, Artificial
  antibody sequence
atggcttgggtgtggaccttgctattcctgatggcagctgcccaaagtatacaggccgaggttcagctgcagcagtctgggcctgaactagtgaagactggggcttcagtgaagatatcctgcaaggcttctggttactctttcactggttactacatgcactgggtcaagcagagccatggaaagagccttgagtggattggatatcttagttgttacagtggtgctactagctacaaccagaagttcaagggcaaggccacatttactgtagacacatcctccaccacagcctacatgcagttcaacagcctgacatctgaagactctgcggtctattactgtgcacgaggggagagctactatgttatggactattggggtcaaggaacctcagtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctggagtctgacctctacactctgagcagctcagtgactgtcccctccagccctcggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatgaacacgaatggctcttacttcgtctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 1022 - DNA, 657 bp, Artificial
  antibody sequence
gacattgtgatgacccagtctccgctctccctgcctgtcagtcttggagatcaagcctccatctcttgcagatctagtcaggacattgtacatagtaatggaaacacctatttagggtggtacctgcagaaaccaggccggtctccgaagctcctgatctacaaagtttccaaccgattttctggggtcccagacaggttcagtggcagtggatcagggacagatttcacactcaagatcagcagagtggaggctgaggatctgggagtttattactgctttcaaagctcacattttccgtggacgttcggtggaggcaccaggctggaaatcaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 1023 - DNA, 657 bp, Artificial
  antibody sequence
gatgttgtgatgacccaaactccactctccctgcctgtcagtcttggagatcaagcctccatctcttgcagatctagtcaggacattgtacatagtaatggaaacacctatttagggtggtacctgcagaaaccaggccggtctccgaagctcctgatctacaaagtttccaaccgattttctggggtcccagacaggttcagtggcagtggatcagggacagatttcacactcaagatcagcagagtggaggctgaggatctgggagtttattactgctttcaaagctcacattttccgtggacgttcggtggaggcaccaggctggaaatcaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 1024 - DNA, 657 bp, Artificial
  antibody sequence
gatattgtgctaactcagtctccactctccctgcctgtcagtcttggagatcaagcctccatctcttgcagatctagtcagagccttgtacacagtaatggaaacacctatttacattggtacctgcagaagccaggccagtctccaaagctcctgatctacaaagtttccaaccgattttctggggtcccagacaggttcagtggcagtggatcagggacagatttcacactcaagatcagcagagtggaggctgaggatctgggagtttatttctgctctcaaagtacacatgttccattcacgttcggctcggggacaaagttggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 1025 - DNA, 654 bp, Artificial
  antibody sequence
gatattgtgctaactcagtctccagcttctttggctgtgtctctagggcagagggccaccatatcctgcagagccagtgaaagtgttgatagttatggcaatagttttatgcactggtaccagcagaaaccaggacagccacccaaactcctcatctatcgtgcatccaacctagaatctgggatccctgccaggttcagtggcagtgggtctaggacagacttcaccctcaccattaatcctgtggaggctgatgatgttgcaacctattactgtcagcaaagtaatgaggatccgctcacgttcggtgctgggaccaagctggagctgaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 1026 - DNA, 639 bp, Artificial
  antibody sequence
gacattgtgatgacccagtctccagcaatcatgtctgcatctccaggggagaaggtcaccataccctgcagtgccagttcaagtgtaagttacatgcactggttccagcagaagccaggcacttcccccaaactctggatttatagcacatccaacctggcttctggagtccctggtcgcttcagtggcagtggatctgggacctcttactctctcacaatcagccgaatggaggctgaagatgctgccacttattactgccagcaaaggagtaattacccgctcacgttcggtgctgggaccaagctggagctgaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 1027 - DNA, 657 bp, Artificial
  antibody sequence
gatgttgtgatgacccaaactccactctccctgcctgtcagtcttggagatcaagcctccatctcttgcagatctagtcagaccattgtacatagtaatggaaacacctatttagaatggtacctgcagaaaccaggccagtctccaaagctcctgatctacaaagtttccaaccgattttctggggtcccagacaggttcagtggcagtggatcagggacagatttcacactcaagatcagccgagtggaggctgaggatctgggagtttattactgctttcaaggttcacatgttccgttcacgttcggaggggggaccaagctggaaataagacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 1028 - DNA, 645 bp, Artificial
  antibody sequence
gatattgtgatgactcaggctgcagcaatcatgtctgcatctcctggggagaaggtcaccttgacctgcagtgccagttcaagtgtaagttccagctacttgtactggtaccagcagaagccaggatcctcccccaaactctggatttatagcacatccaacctggcttctggagtccctgctcgcttcagtggcagtgggtctgggacctcttactctctcacaatcagcagcatggaggctgaagatgctgcctcttatttctgccatcagtggactactttcccacccacgttcggaggggggaccaagctggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 1029 - DNA, 657 bp, Artificial
  antibody sequence
gatgttgtgatgacccaaactccactctccctgcctgtcagtcttggagatcaagcctccatctcttgcagatctagtcagagccttgtacacagtaatggaaacacctatttacattggtacctgcagaagccaggccagtctccaaagctcctgatctacaaagtttccaaccgattttctggggtcccagacaggttcagtggcagtggatcagggacagatttcacactcaagatcagcagagtggaggctgaggatctgggagtttatttctgctctcaaagtacacatgttcctccgacgttcggtggaggcaccaagctggaaatcaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 1030 - DNA, 657 bp, Artificial
  antibody sequence
gatgttgtgatgacccaaactccactctccctgcctgtcagtcttggagatcaagcctccatctcttgcagatctagtcagagccttgtacacagtaatggaaacacctatttacattggtacctgcagaagccaggccagtctccaaagctcctgatctacaaagtttccaaccgattttctggggtcccagacaggttcagtggcagtggatcagggacagatttcacactcaagatcagcagagtggaggctgaggatctgggagtttatttctgctctcaaagtacacatgttcctctcacgttcggtgctgggaccaagctggagctgaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 1031 - DNA, 657 bp, Artificial
  antibody sequence
gacatcaagatgacccagtctccactctccctgcctgtcagtcttggagatcaagcctccatctcttgcagatctagtcagaccattgtacatagtaatggaaacacctatttagaatggtacctgcagaaaccaggccagtctccaaagctcctgatctacaaagtttccaaccgattttctggggtcccagacaggttcagtggcagtggatcagggacagatttcacactcaagatcagccgagtggaggctgaggatctgggagtttattactgctttcaaggttcacatgttccgttcacgttcggaggggggaccaagctggaaataagacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 1032 - DNA, 639 bp, Artificial
  antibody sequence
gatattgtgctaactcagtctccagcaatcatgtctgcatctccaggggagaaggtcaccataacctgcagtgccagctcaagtgtaagttacatgcactggttccagcagaagccaggcacttctcccaaactctggatttatagcacatccaacctggcttctggagtccctgctcgcttcagtggcagtggatctgggacctcttactctctcacaatcagccgaatggaggctgaagatgctgccacttattactgccagcaaaggagtagttacccgtggacgttcggtggaggcaccaagctggaaatcaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 1033 - DNA, 642 bp, Artificial
  antibody sequence
gacattgtgatgacccagtctccatcttccatgtatgcatctctaggagagagagtcactatcacttgcaaggcgagtcaggacattaatagctatttaagctggttccagcagaaaccaggaaaatctcctaagaccctgatctatcgtgcaaacagattggtagatggggtcccatcaaggttcagtggcagtggatctgggcaagattattctctcaccatcagcagcctggagtatgaagatatgggaatttattattgtctacagtatgatgagtttccgtacacgttcggaggggggaccaagctggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 1034 - DNA, 720 bp, Artificial
  antibody sequence
atggagacacattctcaggtctttgtatacatgttgctgtggttgtctggtgtcgagggcgacattgtgatgacccagtctccgctctccctgcctgtcagtcttggagatcaagcctccatctcttgcagatctagtcaggacattgtacatagtaatggaaacacctatttagggtggtacctgcagaaaccaggccggtctccgaagctcctgatctacaaagtttccaaccgattttctggggtcccagacaggttcagtggcagtggatcagggacagatttcacactcaagatcagcagagtggaggctgaggatctgggagtttattactgctttcaaagctcacattttccgtggacgttcggtggaggcaccaggctggaaatcaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 1035 - DNA, 720 bp, Artificial
  antibody sequence
atggagacacattctcaggtctttgtatacatgttgctgtggttgtctggtgtcgagggcgatgttgtgatgacccaaactccactctccctgcctgtcagtcttggagatcaagcctccatctcttgcagatctagtcaggacattgtacatagtaatggaaacacctatttagggtggtacctgcagaaaccaggccggtctccgaagctcctgatctacaaagtttccaaccgattttctggggtcccagacaggttcagtggcagtggatcagggacagatttcacactcaagatcagcagagtggaggctgaggatctgggagtttattactgctttcaaagctcacattttccgtggacgttcggtggaggcaccaggctggaaatcaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 1036 - DNA, 720 bp, Artificial
  antibody sequence
atggagacacattctcaggtctttgtatacatgttgctgtggttgtctggtgtcgagggcgatattgtgctaactcagtctccactctccctgcctgtcagtcttggagatcaagcctccatctcttgcagatctagtcagagccttgtacacagtaatggaaacacctatttacattggtacctgcagaagccaggccagtctccaaagctcctgatctacaaagtttccaaccgattttctggggtcccagacaggttcagtggcagtggatcagggacagatttcacactcaagatcagcagagtggaggctgaggatctgggagtttatttctgctctcaaagtacacatgttccattcacgttcggctcggggacaaagttggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 1037 - DNA, 717 bp, Artificial
  antibody sequence
atggagacacattctcaggtctttgtatacatgttgctgtggttgtctggtgtcgagggcgatattgtgctaactcagtctccagcttctttggctgtgtctctagggcagagggccaccatatcctgcagagccagtgaaagtgttgatagttatggcaatagttttatgcactggtaccagcagaaaccaggacagccacccaaactcctcatctatcgtgcatccaacctagaatctgggatccctgccaggttcagtggcagtgggtctaggacagacttcaccctcaccattaatcctgtggaggctgatgatgttgcaacctattactgtcagcaaagtaatgaggatccgctcacgttcggtgctgggaccaagctggagctgaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 1038 - DNA, 702 bp, Artificial
  antibody sequence
atggagacacattctcaggtctttgtatacatgttgctgtggttgtctggtgtcgagggcgacattgtgatgacccagtctccagcaatcatgtctgcatctccaggggagaaggtcaccataccctgcagtgccagttcaagtgtaagttacatgcactggttccagcagaagccaggcacttcccccaaactctggatttatagcacatccaacctggcttctggagtccctggtcgcttcagtggcagtggatctgggacctcttactctctcacaatcagccgaatggaggctgaagatgctgccacttattactgccagcaaaggagtaattacccgctcacgttcggtgctgggaccaagctggagctgaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 1039 - DNA, 720 bp, Artificial
  antibody sequence
atggagacacattctcaggtctttgtatacatgttgctgtggttgtctggtgtcgagggcgatgttgtgatgacccaaactccactctccctgcctgtcagtcttggagatcaagcctccatctcttgcagatctagtcagaccattgtacatagtaatggaaacacctatttagaatggtacctgcagaaaccaggccagtctccaaagctcctgatctacaaagtttccaaccgattttctggggtcccagacaggttcagtggcagtggatcagggacagatttcacactcaagatcagccgagtggaggctgaggatctgggagtttattactgctttcaaggttcacatgttccgttcacgttcggaggggggaccaagctggaaataagacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 1040 - DNA, 708 bp, Artificial
  antibody sequence
atggagacacattctcaggtctttgtatacatgttgctgtggttgtctggtgtcgagggcgatattgtgatgactcaggctgcagcaatcatgtctgcatctcctggggagaaggtcaccttgacctgcagtgccagttcaagtgtaagttccagctacttgtactggtaccagcagaagccaggatcctcccccaaactctggatttatagcacatccaacctggcttctggagtccctgctcgcttcagtggcagtgggtctgggacctcttactctctcacaatcagcagcatggaggctgaagatgctgcctcttatttctgccatcagtggactactttcccacccacgttcggaggggggaccaagctggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 1041 - DNA, 720 bp, Artificial
  antibody sequence
atggagacacattctcaggtctttgtatacatgttgctgtggttgtctggtgtcgagggcgatgttgtgatgacccaaactccactctccctgcctgtcagtcttggagatcaagcctccatctcttgcagatctagtcagagccttgtacacagtaatggaaacacctatttacattggtacctgcagaagccaggccagtctccaaagctcctgatctacaaagtttccaaccgattttctggggtcccagacaggttcagtggcagtggatcagggacagatttcacactcaagatcagcagagtggaggctgaggatctgggagtttatttctgctctcaaagtacacatgttcctccgacgttcggtggaggcaccaagctggaaatcaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 1042 - DNA, 720 bp, Artificial
  antibody sequence
atggagacacattctcaggtctttgtatacatgttgctgtggttgtctggtgtcgagggcgatgttgtgatgacccaaactccactctccctgcctgtcagtcttggagatcaagcctccatctcttgcagatctagtcagagccttgtacacagtaatggaaacacctatttacattggtacctgcagaagccaggccagtctccaaagctcctgatctacaaagtttccaaccgattttctggggtcccagacaggttcagtggcagtggatcagggacagatttcacactcaagatcagcagagtggaggctgaggatctgggagtttatttctgctctcaaagtacacatgttcctctcacgttcggtgctgggaccaagctggagctgaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 1043 - DNA, 720 bp, Artificial
  antibody sequence
atggagacacattctcaggtctttgtatacatgttgctgtggttgtctggtgtcgagggcgacatcaagatgacccagtctccactctccctgcctgtcagtcttggagatcaagcctccatctcttgcagatctagtcagaccattgtacatagtaatggaaacacctatttagaatggtacctgcagaaaccaggccagtctccaaagctcctgatctacaaagtttccaaccgattttctggggtcccagacaggttcagtggcagtggatcagggacagatttcacactcaagatcagccgagtggaggctgaggatctgggagtttattactgctttcaaggttcacatgttccgttcacgttcggaggggggaccaagctggaaataagacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 1044 - DNA, 702 bp, Artificial
  antibody sequence
atggagacacattctcaggtctttgtatacatgttgctgtggttgtctggtgtcgagggcgatattgtgctaactcagtctccagcaatcatgtctgcatctccaggggagaaggtcaccataacctgcagtgccagctcaagtgtaagttacatgcactggttccagcagaagccaggcacttctcccaaactctggatttatagcacatccaacctggcttctggagtccctgctcgcttcagtggcagtggatctgggacctcttactctctcacaatcagccgaatggaggctgaagatgctgccacttattactgccagcaaaggagtagttacccgtggacgttcggtggaggcaccaagctggaaatcaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 1045 - DNA, 705 bp, Artificial
  antibody sequence
atggagacacattctcaggtctttgtatacatgttgctgtggttgtctggtgtcgagggcgacattgtgatgacccagtctccatcttccatgtatgcatctctaggagagagagtcactatcacttgcaaggcgagtcaggacattaatagctatttaagctggttccagcagaaaccaggaaaatctcctaagaccctgatctatcgtgcaaacagattggtagatggggtcccatcaaggttcagtggcagtggatctgggcaagattattctctcaccatcagcagcctggagtatgaagatatgggaatttattattgtctacagtatgatgagtttccgtacacgttcggaggggggaccaagctggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 1046 - DNA, 1323 bp, Artificial
  antibody sequence
caggttcagctgcagcagtctggggctgagcttgtgatgcctggggcttcagtgaagatgtcctgcaaggcttctggctacacattcactgactactggatgcactgggtgaagcagaggcctggacaaggccttgagtggatcggagcgattgatacttctgatagttatactagctacaatcaaaagttcaagggcaaggccacattgactgtagacgaatcctccagcacagcctacatgcagctcagcagcctgacatctgaggactctgcggtctattactgtgcaagggactacggctacgctatggactactggggtcaaggaacctcagtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctggagtctgacctctacactctgagcagctcagtgactgtcccctccagccctcggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatgaacacgaatggctcttacttcgtctacagcaagctcaatgtgcagaagagcaactgggaggcaggaaatactttcacctgctctgtgttacatgagggcctgcacaaccaccatactgagaagagcctctcccactctcctggtaaa

SEQ ID NO: 1047 - DNA, 1314 bp, Artificial
  antibody sequence
gaggttcagctgcagcagtctggggctatgctggcaaggcctggggcttcagtgacgatgtcctgcaaggcttctggctacacctttaccgattactggatgcactgggtaagacaggggcctggacagggtctggaatggattggcgctatttttcctggaaatagtgatactacctacaatcagaaattcaggggcaaggccaaactgactgcagtcacatctgccatcactgcctacatggaggtcagcagcctgacaaatattgactctgcggtctattactgtacggtaactgaacttgactactggggccaaggcaccactctcacagtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctggagtctgacctctacactctgagcagctcagtgactgtcccctccagccctcggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatgaacacgaatggctcttacttcgtctacagcaagctcaatgtgcagaagagcaactgggaggcaggaaatactttcacctgctctgtgttacatgagggcctgcacaaccaccatactgagaagagcctctcccactctcctggtaaa

SEQ ID NO: 1048 - DNA, 1323 bp, Artificial
  antibody sequence
gaggttcagctgcagcagtctggggctgaccttgtgatgcctgggacttcaatgaagctgtcctgcaaggcttctggctacacattcactgactactggattcactgggtgaagcaggggcctggacaaggccttgagtggatcggagcgattgatacttcggatagttatattaattacaatcaaaagttcacggacaaggccacattgaccgttgacgaatcctccagcacagcctacatgcacctcagcagcctgacatctgaggactctgcggtctattattgtgcaagggactacggctacgctatggactactggggtcaaggaacctcagtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctggagtctgacctctacactctgagcagctcagtgactgtcccctccagccctcggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatgaacacgaatggctcttacttcgtctacagcaagctcaatgtgcagaagagcaactgggaggcaggaaatactttcacctgctctgtgttacatgagggcctgcacaaccaccatactgagaagagcctctcccactctcctggtaaa

SEQ ID NO: 1049 - DNA, 1323 bp, Artificial
  antibody sequence
caggtccaactgcagcagcctggggctgagcttgtgatgcctgggtcttcagtgaagatgtcctgcaaggcttctggctacacattcactgattactggatgcactgggtgaagcagaggccgggacaaggccttgagtggatcggagcgattgatgcttctgatagttatactagctacgatcaaaagttcaagggcaaggccacattgactgttgacgattcctccagcacagcctacattcacctcaacagcctgacatctgaggactctgcggtctattactgtgcaagagacttcggctatgctatggactactggggtcaaggaacctcagtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctggagtctgacctctacactctgagcagctcagtgactgtcccctccagccctcggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatgaacacgaatggctcttacttcgtctacagcaagctcaatgtgcagaagagcaactgggaggcaggaaatactttcacctgctctgtgttacatgagggcctgcacaaccaccatactgagaagagcctctcccactctcctggtaaa

SEQ ID NO: 1050 - DNA, 1332 bp, Artificial
  antibody sequence
gaggttcagctgcagcagtctgggggaggcttagtgaagcctggagggtccctgaaactctcctgtgcagcctctggattcactttcagtagctatgccatgtcttgggttcgccagactccggagaagaggctggagtgggtcgcaaccattactggtggtggtacttacacctactatctagacagtgtgaagggtcgattcaccatctccagagacaatgccaagacctccctgtacctgcaaatgagcagtctgaggtcggaggacacggccatgtattactgtgcaagacatcgggatggtaactacgggtgcttcgatgtctggggcgcagggaccacggtcaccgtctcctcagccaaaacgacacccccatctgtctatccactggcccctggatctgctgcccaaactaaccccatggtgaccctgggatgcctggtcaagggctatttccctgagccagtgacagtgacctggaactctggatccctgtccagcggtgtgcacaccttcccagctgtcctggagtctgacctctacactctgagcagctcagtgactgtcccctccagccctcggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatgaacacgaatggctcttacttcgtctacagcaagctcaatgtgcagaagagcaactgggaggcaggaaatactttcacctgctctgtgttacatgagggcctgcacaaccaccatactgagaagagcctctcccactctcctggtaaa

SEQ ID NO: 1051 - DNA, 1323 bp, Artificial
  antibody sequence
gaggttcagctgcagcagtctggggctgagcttgtgatgcctggggcttcagtgaagatgtcctgcaaggcttctggttacacattcactgactactggatgcactgggtgctgcagaggcctggacaaggccttgagtggatcggagcgattgatacttctgatagttatactacctacaatcaaaaattcaagggcaaggccacattgactgtagacgaatcctccagcacggcctacatgctgctcagcagcctgacatctgaggactctgcggtctattactgtgcaagagactacggctatgctatggactactggggtcaaggatcctcagtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctggagtctgacctctacactctgagcagctcagtgactgtcccctccagccctcggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatgaacacgaatggctcttacttcgtctacagcaagctcaatgtgcagaagagcaactgggaggcaggaaatactttcacctgctctgtgttacatgagggcctgcacaaccaccatactgagaagagcctctcccactctcctggtaaa

SEQ ID NO: 1052 - DNA, 1314 bp, Artificial
  antibody sequence
gagttccagctgcagcagtctggacctgagctggtaaagcctggggcttcagtgaagatgtcctgcaaggcttctggatacacattcactagctattttatacactgggtgaagcagaagcctggacagggccttgagtggattggatttattaatccttacaatgctgatactaactacaatgagaaattcaaaggcaaggccacactgacttcagacaaatcctccagcacagcctacatggagctcagcagcctgacctctgaggactctgcggtctattactgtactccgagtgctatggactactggggtcaaggaacctcagtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctggagtctgacctctacactctgagcagctcagtgactgtcccctccagccctcggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatgaacacgaatggctcttacttcgtctacagcaagctcaatgtgcagaagagcaactgggaggcaggaaatactttcacctgctctgtgttacatgagggcctgcacaaccaccatactgagaagagcctctcccactctcctggtaaa

SEQ ID NO: 1053 - DNA, 1323 bp, Artificial
  antibody sequence
caggttcagctgcagcagtctggggctgagcttgtgatgcctggggcttcagtgaagatgtcctgcaaggcttctggctacacattcactgactactggatgcactgggtgaagcagaggcctggacaaggccttgagtggatcggagcgattgatacttctgatagttatactacctacaatcaaaagttcaagggcaaggccacattgactgtagacgaatcctccagcacagcctacatgcagctcagcagcctgacatctgaggactctgcggtctattactgtgcaagggactacggctacgctatggactactggggtcaaggaacctcagtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctggagtctgacctctacactctgagcagctcagtgactgtcccctccagccctcggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatgaacacgaatggctcttacttcgtctacagcaagctcaatgtgcagaagagcaactgggaggcaggaaatactttcacctgctctgtgttacatgagggcctgcacaaccaccatactgagaagagcctctcccactctcctggtaaa

SEQ ID NO: 1054 - DNA, 1383 bp, Artificial
  antibody sequence
atggcttgggtgtggaccttgctattcctgatggcagctgcccaaagtatacaggcccaggttcagctgcagcagtctggggctgagcttgtgatgcctggggcttcagtgaagatgtcctgcaaggcttctggctacacattcactgactactggatgcactgggtgaagcagaggcctggacaaggccttgagtggatcggagcgattgatacttctgatagttatactagctacaatcaaaagttcaagggcaaggccacattgactgtagacgaatcctccagcacagcctacatgcagctcagcagcctgacatctgaggactctgcggtctattactgtgcaagggactacggctacgctatggactactggggtcaaggaacctcagtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctggagtctgacctctacactctgagcagctcagtgactgtcccctccagccctcggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatgaacacgaatggctcttacttcgtctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 1055 - DNA, 1374 bp, Artificial
  antibody sequence
atggcttgggtgtggaccttgctattcctgatggcagctgcccaaagtatacaggccgaggttcagctgcagcagtctggggctatgctggcaaggcctggggcttcagtgacgatgtcctgcaaggcttctggctacacctttaccgattactggatgcactgggtaagacaggggcctggacagggtctggaatggattggcgctatttttcctggaaatagtgatactacctacaatcagaaattcaggggcaaggccaaactgactgcagtcacatctgccatcactgcctacatggaggtcagcagcctgacaaatattgactctgcggtctattactgtacggtaactgaacttgactactggggccaaggcaccactctcacagtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctggagtctgacctctacactctgagcagctcagtgactgtcccctccagccctcggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatgaacacgaatggctcttacttcgtctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 1056 - DNA, 1383 bp, Artificial
  antibody sequence
atggcttgggtgtggaccttgctattcctgatggcagctgcccaaagtatacaggccgaggttcagctgcagcagtctggggctgaccttgtgatgcctgggacttcaatgaagctgtcctgcaaggcttctggctacacattcactgactactggattcactgggtgaagcaggggcctggacaaggccttgagtggatcggagcgattgatacttcggatagttatattaattacaatcaaaagttcacggacaaggccacattgaccgttgacgaatcctccagcacagcctacatgcacctcagcagcctgacatctgaggactctgcggtctattattgtgcaagggactacggctacgctatggactactggggtcaaggaacctcagtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctggagtctgacctctacactctgagcagctcagtgactgtcccctccagccctcggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatgaacacgaatggctcttacttcgtctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 1057 - DNA, 1383 bp, Artificial
  antibody sequence
atggcttgggtgtggaccttgctattcctgatggcagctgcccaaagtatacaggcccaggtccaactgcagcagcctggggctgagcttgtgatgcctgggtcttcagtgaagatgtcctgcaaggcttctggctacacattcactgattactggatgcactgggtgaagcagaggccgggacaaggccttgagtggatcggagcgattgatgcttctgatagttatactagctacgatcaaaagttcaagggcaaggccacattgactgttgacgattcctccagcacagcctacattcacctcaacagcctgacatctgaggactctgcggtctattactgtgcaagagacttcggctatgctatggactactggggtcaaggaacctcagtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctggagtctgacctctacactctgagcagctcagtgactgtcccctccagccctcggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatgaacacgaatggctcttacttcgtctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 1058 - DNA, 1392 bp, Artificial
  antibody sequence
atggcttgggtgtggaccttgctattcctgatggcagctgcccaaagtatacaggccgaggttcagctgcagcagtctgggggaggcttagtgaagcctggagggtccctgaaactctcctgtgcagcctctggattcactttcagtagctatgccatgtcttgggttcgccagactccggagaagaggctggagtgggtcgcaaccattactggtggtggtacttacacctactatctagacagtgtgaagggtcgattcaccatctccagagacaatgccaagacctccctgtacctgcaaatgagcagtctgaggtcggaggacacggccatgtattactgtgcaagacatcgggatggtaactacgggtgcttcgatgtctggggcgcagggaccacggtcaccgtctcctcagccaaaacgacacccccatctgtctatccactggcccctggatctgctgcccaaactaaccccatggtgaccctgggatgcctggtcaagggctatttccctgagccagtgacagtgacctggaactctggatccctgtccagcggtgtgcacaccttcccagctgtcctggagtctgacctctacactctgagcagctcagtgactgtcccctccagccctcggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatgaacacgaatggctcttacttcgtctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 1059 - DNA, 1383 bp, Artificial
  antibody sequence
atggcttgggtgtggaccttgctattcctgatggcagctgcccaaagtatacaggccgaggttcagctgcagcagtctggggctgagcttgtgatgcctggggcttcagtgaagatgtcctgcaaggcttctggttacacattcactgactactggatgcactgggtgctgcagaggcctggacaaggccttgagtggatcggagcgattgatacttctgatagttatactacctacaatcaaaaattcaagggcaaggccacattgactgtagacgaatcctccagcacggcctacatgctgctcagcagcctgacatctgaggactctgcggtctattactgtgcaagagactacggctatgctatggactactggggtcaaggatcctcagtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctggagtctgacctctacactctgagcagctcagtgactgtcccctccagccctcggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatgaacacgaatggctcttacttcgtctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 1060 - DNA, 1374 bp, Artificial
  antibody sequence
atggcttgggtgtggaccttgctattcctgatggcagctgcccaaagtatacaggccgagttccagctgcagcagtctggacctgagctggtaaagcctggggcttcagtgaagatgtcctgcaaggcttctggatacacattcactagctattttatacactgggtgaagcagaagcctggacagggccttgagtggattggatttattaatccttacaatgctgatactaactacaatgagaaattcaaaggcaaggccacactgacttcagacaaatcctccagcacagcctacatggagctcagcagcctgacctctgaggactctgcggtctattactgtactccgagtgctatggactactggggtcaaggaacctcagtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctggagtctgacctctacactctgagcagctcagtgactgtcccctccagccctcggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatgaacacgaatggctcttacttcgtctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 1061 - DNA, 1383 bp, Artificial
  antibody sequence
atggcttgggtgtggaccttgctattcctgatggcagctgcccaaagtatacaggcccaggttcagctgcagcagtctggggctgagcttgtgatgcctggggcttcagtgaagatgtcctgcaaggcttctggctacacattcactgactactggatgcactgggtgaagcagaggcctggacaaggccttgagtggatcggagcgattgatacttctgatagttatactacctacaatcaaaagttcaagggcaaggccacattgactgtagacgaatcctccagcacagcctacatgcagctcagcagcctgacatctgaggactctgcggtctattactgtgcaagggactacggctacgctatggactactggggtcaaggaacctcagtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctggagtctgacctctacactctgagcagctcagtgactgtcccctccagccctcggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatgaacacgaatggctcttacttcgtctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 1062 - DNA, 639 bp, Artificial
  antibody sequence
caaattgttctcacccagtctccagcaatcatgtctgcatctccaggggagaaggtcaccataacctgcagtgccagcttaagtgtcagttacatgcactggttccagcagaagccaggcacttctcccaaactctggatttatagcgcttccaacctggcttctggagtccctgctcgcttcagtggcagtggatctgggacctcttactctctcacaatcagccgaatggaggctgaagatgctgccacttattactgccagcaaaggagtagttacccattcacgttcggctcggggacaaagttggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 1063 - DNA, 657 bp, Artificial
  antibody sequence
gatgttgtgatgacccaaactccactctccctgcctgtcagtcttggagatcaagcctccatctcttgcagatctagtcagagccttatacacaatgatggaaacacctatttacattggtacctccagaagccaggccagtctccaaagctcctgatctacaaagtttccaaccgattttctggggtcccagacaggttcagtggcagtggatcagggacagatttcacagtcaagatcagcagagtggaggctgaggatctgggagtttatttctgctctcaaagtacacatgttccgttcacgttcggtgctgggaccaagctggagctgaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 1064 - DNA, 639 bp, Artificial
  antibody sequence
caaattgttctctcccagtctccagcaatcatgtctgcatctccaggggagaaggtcaccataacctgcagtgccagcttaagtgtcagtttcatgcactggttccagcagaagccaggcacttctcccaaactctggatttatagcgcttccaacctggcttctggagtccctgctcgcttcagtggcagtggatctgggacctcttactctctcacaatcagccgaatggaggctgaagatgctgccacttattactgccagcaaaggagtagctacccattcacgttcggctcggggacaaagttggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 1065 - DNA, 639 bp, Artificial
  antibody sequence
caaattgttctcacccagtctccagcaatcatgtctgcatctccaggggagaaggtcaccataacctgcagtgccagctcaagtgtaagtttcatgcactggttccagcagaagccaggcacttctcccaaactctggatttatagcacatccaacctggcttctggagtccctgctcgcttcagtggcagtggatctgggacctcttactctctcacaatcagccgaatggaggctgaagatgctgccacttattactgccagcaaaggagtacttacccatacacgttcggaggggggaccaagatggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 1066 - DNA, 645 bp, Artificial
  antibody sequence
gatattgtgctaactcagtctccagcaatcatgtctgcatctctaggggaacgggtcaccatgacctgcactgccagctcaagtgtaagttccagttacttgcactggtaccagcagaagccaggatcctcccccaaactctgggtttatagcacatccaacctggcttctggagtcccagctcgcttcagtggcagtgggtctgggtcctcttactctctcacaatcagcagcatggagcctgaagatactgccacttattactgccaccagtatcatcgttccccacagacgttcggtggaggcaccaagctggaaatcaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 1067 - DNA, 639 bp, Artificial
  antibody sequence
caaattgttctcacccagtctccagcaatcatgtctgcatctccaggggagaaggtcaccattacctgcagtgccagctcaagtgtcagtttcatgcactggttccagcagaagccaggcacttctcccaaactctggatttatagcgcatccaacctggcttctggagtccctgctcgcttcagtggcagtggatctgggacctcttactctctcacaatcagccgaatggaggctgaagatgctgccacttattactgccagcaaaggagtagttacccatacacgttcggaggggggaccaagctggaaataaagcgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 1068 - DNA, 639 bp, Artificial
  antibody sequence
gatattgtgctaactcagtctccagcaatcatgtctgcatctccaggggaaaaggtcaccatgacctgcagtgccagctcaagtgtaagttacatgcactggtaccagcagaagtcaagcacctcccccaaactctggatttatgacacatccaaactggcttctggagtcccaggtcgcttcagtggcagtgggtctggaaactcttactctctcacgatcagcagcatggaggctgaagatgttgccacttattactgttttcaggggagtgggtacccactcacgttcggctcggggacaaagttggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 1069 - DNA, 639 bp, Artificial
  antibody sequence
caaattgttctcacccagtctccagcaatcatgtctgcatctccaggggagaaggtcaccataacctgcagtgccagctcaagtgtcagttacatgcactggttccagcagaagccaggcacttctcccaaactctggatttatagcgcatccaacctggcttctggagtccctgctcgcttcagtggcagtggatctgggacctcttactctctcacaatcagccgaatggaggctgaagatgctgccacttattactgccagcaaaggagtagttacccattcacgttcggctcggggacaaagttggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 1070 - DNA, 702 bp, Artificial
  antibody sequence
atggagacacattctcaggtctttgtatacatgttgctgtggttgtctggtgtcgagggccaaattgttctcacccagtctccagcaatcatgtctgcatctccaggggagaaggtcaccataacctgcagtgccagcttaagtgtcagttacatgcactggttccagcagaagccaggcacttctcccaaactctggatttatagcgcttccaacctggcttctggagtccctgctcgcttcagtggcagtggatctgggacctcttactctctcacaatcagccgaatggaggctgaagatgctgccacttattactgccagcaaaggagtagttacccattcacgttcggctcggggacaaagttggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 1071 - DNA, 720 bp, Artificial
  antibody sequence
atggagacacattctcaggtctttgtatacatgttgctgtggttgtctggtgtcgagggcgatgttgtgatgacccaaactccactctccctgcctgtcagtcttggagatcaagcctccatctcttgcagatctagtcagagccttatacacaatgatggaaacacctatttacattggtacctccagaagccaggccagtctccaaagctcctgatctacaaagtttccaaccgattttctggggtcccagacaggttcagtggcagtggatcagggacagatttcacagtcaagatcagcagagtggaggctgaggatctgggagtttatttctgctctcaaagtacacatgttccgttcacgttcggtgctgggaccaagctggagctgaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 1072 - DNA, 702 bp, Artificial
  antibody sequence
atggagacacattctcaggtctttgtatacatgttgctgtggttgtctggtgtcgagggccaaattgttctctcccagtctccagcaatcatgtctgcatctccaggggagaaggtcaccataacctgcagtgccagcttaagtgtcagtttcatgcactggttccagcagaagccaggcacttctcccaaactctggatttatagcgcttccaacctggcttctggagtccctgctcgcttcagtggcagtggatctgggacctcttactctctcacaatcagccgaatggaggctgaagatgctgccacttattactgccagcaaaggagtagctacccattcacgttcggctcggggacaaagttggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 1073 - DNA, 702 bp, Artificial
  antibody sequence
atggagacacattctcaggtctttgtatacatgttgctgtggttgtctggtgtcgagggccaaattgttctcacccagtctccagcaatcatgtctgcatctccaggggagaaggtcaccataacctgcagtgccagctcaagtgtaagtttcatgcactggttccagcagaagccaggcacttctcccaaactctggatttatagcacatccaacctggcttctggagtccctgctcgcttcagtggcagtggatctgggacctcttactctctcacaatcagccgaatggaggctgaagatgctgccacttattactgccagcaaaggagtacttacccatacacgttcggaggggggaccaagatggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 1074 - DNA, 708 bp, Artificial
  antibody sequence
atggagacacattctcaggtctttgtatacatgttgctgtggttgtctggtgtcgagggcgatattgtgctaactcagtctccagcaatcatgtctgcatctctaggggaacgggtcaccatgacctgcactgccagctcaagtgtaagttccagttacttgcactggtaccagcagaagccaggatcctcccccaaactctgggtttatagcacatccaacctggcttctggagtcccagctcgcttcagtggcagtgggtctgggtcctcttactctctcacaatcagcagcatggagcctgaagatactgccacttattactgccaccagtatcatcgttccccacagacgttcggtggaggcaccaagctggaaatcaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 1075 - DNA, 702 bp, Artificial
  antibody sequence
atggagacacattctcaggtctttgtatacatgttgctgtggttgtctggtgtcgagggccaaattgttctcacccagtctccagcaatcatgtctgcatctccaggggagaaggtcaccattacctgcagtgccagctcaagtgtcagtttcatgcactggttccagcagaagccaggcacttctcccaaactctggatttatagcgcatccaacctggcttctggagtccctgctcgcttcagtggcagtggatctgggacctcttactctctcacaatcagccgaatggaggctgaagatgctgccacttattactgccagcaaaggagtagttacccatacacgttcggaggggggaccaagctggaaataaagcgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 1076 - DNA, 702 bp, Artificial
  antibody sequence
atggagacacattctcaggtctttgtatacatgttgctgtggttgtctggtgtcgagggcgatattgtgctaactcagtctccagcaatcatgtctgcatctccaggggaaaaggtcaccatgacctgcagtgccagctcaagtgtaagttacatgcactggtaccagcagaagtcaagcacctcccccaaactctggatttatgacacatccaaactggcttctggagtcccaggtcgcttcagtggcagtgggtctggaaactcttactctctcacgatcagcagcatggaggctgaagatgttgccacttattactgttttcaggggagtgggtacccactcacgttcggctcggggacaaagttggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 1077 - DNA, 702 bp, Artificial
  antibody sequence
atggagacacattctcaggtctttgtatacatgttgctgtggttgtctggtgtcgagggccaaattgttctcacccagtctccagcaatcatgtctgcatctccaggggagaaggtcaccataacctgcagtgccagctcaagtgtcagttacatgcactggttccagcagaagccaggcacttctcccaaactctggatttatagcgcatccaacctggcttctggagtccctgctcgcttcagtggcagtggatctgggacctcttactctctcacaatcagccgaatggaggctgaagatgctgccacttattactgccagcaaaggagtagttacccattcacgttcggctcggggacaaagttggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 1078 - DNA, 1335 bp, Artificial
  antibody sequence
gaggttcagctgcagcagtctgggcctgagctgaagaagcctggagagacagtcaagatctcctgcaagacttctggatataccttcacaatttatggaatgaactggatgaagcaggctccaggaaagggtttaaagtggatgggctggataaacacctacactggagagccaacatatgctgatgacttcaagggacggtttgccttctctttggaaacctctgccagcactgcctatttgcagatcaacaacctcaaaaatgaggacacggctacatatttctgtgcaagatgctactataaatacgaggactatgctatggactactggggtcaaggaacctcagtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctggagtctgacctctacactctgagcagctcagtgactgtcccctccagccctcggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatgaacacgaatggctcttacttcgtctacagcaagctcaatgtgcagaagagcaactgggaggcaggaaatactttcacctgctctgtgttacatgagggcctgcacaaccaccatactgagaagagcctctcccactctcctggtaaa

SEQ ID NO: 1079 - DNA, 1329 bp, Artificial
  antibody sequence
gaagtgaagctggtggagtctgggggaggtttagtgaagcctggagggtccctgaaactctcctgtgcagcctctggattcactttcagtagctatgccatgtcttgggttcgccagactccagaaaagaggctggagtgggtcgcagccattaatggtaatggtggtagcacctactatccagacactgtgaaggaccgattcaccatctccagagacaatgccaagaacaccctttacctacaaatgagcagtctgaggtctgaggacacagccttgtattactgtgcaagacatagggctgatggtccctggtttacttactggggccaagggactctggtcactgtctctgcagccaaaacgacacccccatctgtctatccactggcccctggatctgctgcccaaactaaccccatggtgaccctgggatgcctggtcaagggctatttccctgagccagtgacagtgacctggaactctggatccctgtccagcggtgtgcacaccttcccagctgtcctggagtctgacctctacactctgagcagctcagtgactgtcccctccagccctcggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatgaacacgaatggctcttacttcgtctacagcaagctcaatgtgcagaagagcaactgggaggcaggaaatactttcacctgctctgtgttacatgagggcctgcacaaccaccatactgagaagagcctctcccactctcctggtaaa

SEQ ID NO: 1080 - DNA, 1326 bp, Artificial
  antibody sequence
gaagtgaagctggtggaaagcggcggaggcctggtgaaacctggcggcagcctgaagctgagctgcgccgccagcggcttcaccttcagcaactacgccatgagctgggtgcgccagacccccgagaagcggctggaatgggtggccagcatcagcagacggggcagcacctactaccccgacagcgtgaagggccggttcaccatcagccgggacaacgcccggaacatcctgtacctgcagatgagcagcctgcggagcgaggacaccgccctgtactactgcgccaccgtgtactacgacaacccttggtttgtgtactggggccagggcaccctggtgacagtgtccgctgccaaaacgacaccaccaagtgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctggagtctgacctctacactctgagcagctcagtgactgtcccctccagccctcggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatgaacacgaatggctcttacttcgtctacagcaagctcaatgtgcagaagagcaactgggaggcaggaaatactttcacctgctctgtgttacatgagggcctgcacaaccaccatactgagaagagcctctcccactctcctggtaaa

SEQ ID NO: 1081 - DNA, 1335 bp, Artificial
  antibody sequence
cagatccagctggtgcagagcggccctgagctgaagaaacccggcgagacagtgaagatcagctgcaagaccagcggctacaccttcaccatctacggcatgaactggaccaagcaggcccctggcaagggcctgaagtggatgggctggatcaacacctacaccggcgagcccacctacgccgacgacttcaagggcagattcgccttcagcctggaaaccagcgccagcaccgcctacctgcagatcaacaacctgaagaacgaggacaccgccacctacttttgcgcccggtgctactataagtacgaggactacgccatggactactggggccagggcaccagcgtgaccgtgtcctctgccaaaacgacaccaccaagtgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctggagtctgacctctacactctgagcagctcagtgactgtcccctccagccctcggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatgaacacgaatggctcttacttcgtctacagcaagctcaatgtgcagaagagcaactgggaggcaggaaatactttcacctgctctgtgttacatgagggcctgcacaaccaccatactgagaagagcctctcccactctcctggtaaa

SEQ ID NO: 1082 - DNA, 1329 bp, Artificial
  antibody sequence
gacgtgaagctggtggaaagcggcggaggcctggtgaaacctggcggcagcctgaagctgagctgcgccgccagcggcttcaccttcagcagctacgccatgagctgggtgcgccagacccccgagaagcggctggaatgggtggccgccatcaacggcaacggcggcagcacctactaccccgacaccgtgaaggaccggttcaccatcagccgggacaacgccaagaacaccctgtacctgcagatgagcagcctgcggagcgaggacaccgccctgtactactgcgccagacacagagccgacggcccctggttcacatactggggccagggcaccctggtgacagtgtccgctgccaaaacgacaccaccaagtgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctggagtctgacctctacactctgagcagctcagtgactgtcccctccagccctcggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatgaacacgaatggctcttacttcgtctacagcaagctcaatgtgcagaagagcaactgggaggcaggaaatactttcacctgctctgtgttacatgagggcctgcacaaccaccatactgagaagagcctctcccactctcctggtaaa

SEQ ID NO: 1083 - DNA, 1326 bp, Artificial; identical to SEQ ID NO: 1080
  antibody sequence

SEQ ID NO: 1084 - DNA, 1395 bp, Artificial
  antibody sequence
atggcttgggtgtggaccttgctattcctgatggcagctgcccaaagtatacaggccgaggttcagctgcagcagtctgggcctgagctgaagaagcctggagagacagtcaagatctcctgcaagacttctggatataccttcacaatttatggaatgaactggatgaagcaggctccaggaaagggtttaaagtggatgggctggataaacacctacactggagagccaacatatgctgatgacttcaagggacggtttgccttctctttggaaacctctgccagcactgcctatttgcagatcaacaacctcaaaaatgaggacacggctacatatttctgtgcaagatgctactataaatacgaggactatgctatggactactggggtcaaggaacctcagtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctggagtctgacctctacactctgagcagctcagtgactgtcccctccagccctcggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatgaacacgaatggctcttacttcgtctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 1085 - DNA, 1389 bp, Artificial
  antibody sequence
atggcttgggtgtggaccttgctattcctgatggcagctgcccaaagtatacaggccgaagtgaagctggtggagtctgggggaggtttagtgaagcctggagggtccctgaaactctcctgtgcagcctctggattcactttcagtagctatgccatgtcttgggttcgccagactccagaaaagaggctggagtgggtcgcagccattaatggtaatggtggtagcacctactatccagacactgtgaaggaccgattcaccatctccagagacaatgccaagaacaccctttacctacaaatgagcagtctgaggtctgaggacacagccttgtattactgtgcaagacatagggctgatggtccctggtttacttactggggccaagggactctggtcactgtctctgcagccaaaacgacacccccatctgtctatccactggcccctggatctgctgcccaaactaaccccatggtgaccctgggatgcctggtcaagggctatttccctgagccagtgacagtgacctggaactctggatccctgtccagcggtgtgcacaccttcccagctgtcctggagtctgacctctacactctgagcagctcagtgactgtcccctccagccctcggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatgaacacgaatggctcttacttcgtctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 1086 - DNA, 1386 bp, Artificial
  antibody sequence
atggcttgggtgtggaccttgctattcctgatggcagctgcccaaagtatacaggccgaagtgaagctggtggaaagcggcggaggcctggtgaaacctggcggcagcctgaagctgagctgcgccgccagcggcttcaccttcagcaactacgccatgagctgggtgcgccagacccccgagaagcggctggaatgggtggccagcatcagcagacggggcagcacctactaccccgacagcgtgaagggccggttcaccatcagccgggacaacgcccggaacatcctgtacctgcagatgagcagcctgcggagcgaggacaccgccctgtactactgcgccaccgtgtactacgacaacccttggtttgtgtactggggccagggcaccctggtgacagtgtccgctgccaaaacgacaccaccaagtgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctggagtctgacctctacactctgagcagctcagtgactgtcccctccagccctcggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatgaacacgaatggctcttacttcgtctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 1087 - DNA, 1395 bp, Artificial
  antibody sequence
atggcttgggtgtggaccttgctattcctgatggcagctgcccaaagtatacaggcccagatccagctggtgcagagcggccctgagctgaagaaacccggcgagacagtgaagatcagctgcaagaccagcggctacaccttcaccatctacggcatgaactggaccaagcaggcccctggcaagggcctgaagtggatgggctggatcaacacctacaccggcgagcccacctacgccgacgacttcaagggcagattcgccttcagcctggaaaccagcgccagcaccgcctacctgcagatcaacaacctgaagaacgaggacaccgccacctacttttgcgcccggtgctactataagtacgaggactacgccatggactactggggccagggcaccagcgtgaccgtgtcctctgccaaaacgacaccaccaagtgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctggagtctgacctctacactctgagcagctcagtgactgtcccctccagccctcggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatgaacacgaatggctcttacttcgtctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 1088 - DNA, 1389 bp, Artificial
  antibody sequence
atggcttgggtgtggaccttgctattcctgatggcagctgcccaaagtatacaggccgacgtgaagctggtggaaagcggcggaggcctggtgaaacctggcggcagcctgaagctgagctgcgccgccagcggcttcaccttcagcagctacgccatgagctgggtgcgccagacccccgagaagcggctggaatgggtggccgccatcaacggcaacggcggcagcacctactaccccgacaccgtgaaggaccggttcaccatcagccgggacaacgccaagaacaccctgtacctgcagatgagcagcctgcggagcgaggacaccgccctgtactactgcgccagacacagagccgacggcccctggttcacatactggggccagggcaccctggtgacagtgtccgctgccaaaacgacaccaccaagtgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctggagtctgacctctacactctgagcagctcagtgactgtcccctccagccctcggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatgaacacgaatggctcttacttcgtctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 1089 - DNA, 1386 bp, Artificial; identical to SEQ ID NO: 1086
  antibody sequence

SEQ ID NO: 1090 - DNA, 657 bp, Artificial
  antibody sequence
gatgttgtgatgacccaaactccactcactttgtcggttaccattggacaacccgcctccatctcttgcaagtcaagtcagagcctcttagatagtgatggaaagacatatttgaattggttgttacagaggccaggccagtctccgaagcgcctaatctatgtggtgtctaaattggactctggagtccctgacaggttcactggcagtggatcagggacagatttcacactgaaaatcagcagagtggaggctgaggatttgggagtttattattgctggcaaggtacacattttccgctcacgttcggtgctgggaccaagctggagctgaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 1091 - DNA, 642 bp, Artificial
  antibody sequence
gatgttgtgatgacccaaactccatcctccttttctgtatctctaggagacggagtcaccattacttgcaaggcaagtgaggacatatatattcggttagcctggtatcagcagaaaccaggaaatgctcctaggctcctaatatttggtgcaaccagtttggaaactggggttccttcaagattcagtggcagtggatctggaaaggattacactctcagcattaccagtcttcagactgaagatgttgctacttattactgtcaacagtattggagaactccgctcacgttcggtgctgggaccaagctggagctgaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 1092 - DNA, 657 bp, Artificial
  antibody sequence
gacgtggtgatgacccagacccccctgaccctgagcgtgaccatcggccagcctgccagcatcagctgcaagagcagccagagcctgctggacagcgacggcaagacctacctgaactggctgctgcagcggcctggccagagccccaagcggctgatctacctggtgtccaagctggactccggcgtgcccgacagattcacaggcagcggcagcggcaccgacttcaccctgaagatcagccgggtggaagccgaggacctgggcgtgtactactgctggcagggcacccacttcccactgaccttcggagccggcaccaagctggaactgaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 1093 - DNA, 657 bp, Artificial; identical to SEQ ID NO: 1092
  antibody sequence

SEQ ID NO: 1094 - DNA, 657 bp, Artificial; identical to SEQ ID NO: 1090
  antibody sequence

SEQ ID NO: 1095 - DNA, 657 bp, Artificial; identical to SEQ ID NO: 1090
  antibody sequence

SEQ ID NO: 1096 - DNA, 720 bp, Artificial
  antibody sequence
atggagacacattctcaggtctttgtatacatgttgctgtggttgtctggtgtcgagggcgatgttgtgatgacccaaactccactcactttgtcggttaccattggacaacccgcctccatctcttgcaagtcaagtcagagcctcttagatagtgatggaaagacatatttgaattggttgttacagaggccaggccagtctccgaagcgcctaatctatgtggtgtctaaattggactctggagtccctgacaggttcactggcagtggatcagggacagatttcacactgaaaatcagcagagtggaggctgaggatttgggagtttattattgctggcaaggtacacattttccgctcacgttcggtgctgggaccaagctggagctgaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 1097 - DNA, 705 bp, Artificial
  antibody sequence
atggagacacattctcaggtctttgtatacatgttgctgtggttgtctggtgtcgagggcgatgttgtgatgacccaaactccatcctccttttctgtatctctaggagacggagtcaccattacttgcaaggcaagtgaggacatatatattcggttagcctggtatcagcagaaaccaggaaatgctcctaggctcctaatatttggtgcaaccagtttggaaactggggttccttcaagattcagtggcagtggatctggaaaggattacactctcagcattaccagtcttcagactgaagatgttgctacttattactgtcaacagtattggagaactccgctcacgttcggtgctgggaccaagctggagctgaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 1098 - DNA, 720 bp, Artificial
  antibody sequence
atggagacacattctcaggtctttgtatacatgttgctgtggttgtctggtgtcgagggcgacgtggtgatgacccagacccccctgaccctgagcgtgaccatcggccagcctgccagcatcagctgcaagagcagccagagcctgctggacagcgacggcaagacctacctgaactggctgctgcagcggcctggccagagccccaagcggctgatctacctggtgtccaagctggactccggcgtgcccgacagattcacaggcagcggcagcggcaccgacttcaccctgaagatcagccgggtggaagccgaggacctgggcgtgtactactgctggcagggcacccacttcccactgaccttcggagccggcaccaagctggaactgaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 1099 - DNA, 720 bp, Artificial; identical to SEQ ID NO: 1098
  antibody sequence

SEQ ID NO: 1100 - DNA, 720 bp, Artificial; identical to SEQ ID NO: 1096
  antibody sequence

SEQ ID NO: 1101 - DNA, 720 bp, Artificial; identical to SEQ ID NO: 1096
  antibody sequence

SEQ ID NO: 1102 - DNA, 1344 bp, Artificial
  antibody sequence
gaagtgatgctggtggaaagcggcggaggcctggtgaaacctggcggcagcctgaagctgagctgcgccgccagcggcttcaccttcagcaactacgccatgagctgggtccgccagacccccgagaagcggctggaatgggtggccagcatcagcagacggggcagcacctactaccccgacagcggcaagggccggttcaccatcagccgggacaacgcccggaacatcccctacctgcagatgagcagcctgcggagcgaggacaccgccctgtactactgcgccaccgtgtactacgacaacccttggtttgtgtactggggccagggcaccctggtgacagtgtccgctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaa

SEQ ID NO: 1103 - DNA, 1344 bp, Artificial
  antibody sequence
gaagtgatgctggtggaaagcggcggaggcctggtgaaacctggcggcagcctgaagctgagctgcgccgccagcggcttcaccttcagcaactacgccatgagctgggtccgccagacccccgagaagcggctggaatgggtggccagcatcagcagacggggcagcacctactaccccgacagcgtgaagggccggttcaccatcagccgggacaacgcccggaacatcctgtacctgcagatgagcagcctgcggagcgaggacaccgccctgtactactgcgccaccgtgtactacgacaacccttggtttgtgtactggggccagggcaccctggtgacagtgtccgctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaa

SEQ ID NO: 1104 - DNA, 1344 bp, Artificial
  antibody sequence
gaagtgaagctggtggaaagcggcggaggcctggtgaaacctggcggcagcctgaagctgagctgcgccgccagcggcttcaccttcagcaactacgccatgagctgggtccgccagacccccgagaagcggctggaatgggtggccagcatcagcagacggggcagcacctactaccccgacagcgtgaagggccggttcaccatcagccgggacaacgcccggaacatcctgtacctgcagatgagcagcctgcggagcgaggacaccgccctgtactactgcgccaccgtgtactacgacaacccttggtttgtgtactggggccagggcaccctggtgacagtgtccgctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaa

SEQ ID NO: 1105 - DNA, 1344 bp, Artificial; identical to SEQ ID NO: 1104
  antibody sequence

SEQ ID NO: 1106 - DNA, 1344 bp, Artificial; identical to SEQ ID NO: 1104
  antibody sequence

SEQ ID NO: 1107 - DNA, 1344 bp, Artificial; identical to SEQ ID NO: 1103
  antibody sequence

SEQ ID NO: 1108 - DNA, 1404 bp, Artificial
  antibody sequence
atggcttgggtgtggaccttgctattcctgatggcagctgcccaaagtatacaggccgaagtgatgctggtggaaagcggcggaggcctggtgaaacctggcggcagcctgaagctgagctgcgccgccagcggcttcaccttcagcaactacgccatgagctgggtccgccagacccccgagaagcggctggaatgggtggccagcatcagcagacggggcagcacctactaccccgacagcggcaagggccggttcaccatcagccgggacaacgcccggaacatcccctacctgcagatgagcagcctgcggagcgaggacaccgccctgtactactgcgccaccgtgtactacgacaacccttggtttgtgtactggggccagggcaccctggtgacagtgtccgctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatga

SEQ ID NO: 1109 - DNA, 1404 bp, Artificial
  antibody sequence
atggcttgggtgtggaccttgctattcctgatggcagctgcccaaagtatacaggccgaagtgatgctggtggaaagcggcggaggcctggtgaaacctggcggcagcctgaagctgagctgcgccgccagcggcttcaccttcagcaactacgccatgagctgggtccgccagacccccgagaagcggctggaatgggtggccagcatcagcagacggggcagcacctactaccccgacagcgtgaagggccggttcaccatcagccgggacaacgcccggaacatcctgtacctgcagatgagcagcctgcggagcgaggacaccgccctgtactactgcgccaccgtgtactacgacaacccttggtttgtgtactggggccagggcaccctggtgacagtgtccgctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatga

SEQ ID NO: 1110 - DNA, 1404 bp, Artificial
  antibody sequence
atggcttgggtgtggaccttgctattcctgatggcagctgcccaaagtatacaggccgaagtgaagctggtggaaagcggcggaggcctggtgaaacctggcggcagcctgaagctgagctgcgccgccagcggcttcaccttcagcaactacgccatgagctgggtccgccagacccccgagaagcggctggaatgggtggccagcatcagcagacggggcagcacctactaccccgacagcgtgaagggccggttcaccatcagccgggacaacgcccggaacatcctgtacctgcagatgagcagcctgcggagcgaggacaccgccctgtactactgcgccaccgtgtactacgacaacccttggtttgtgtactggggccagggcaccctggtgacagtgtccgctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatga

SEQ ID NO: 1111 - DNA, 1404 bp, Artificial; identical to SEQ ID NO: 1110
  antibody sequence

SEQ ID NO: 1112 - DNA, 1404 bp, Artificial; identical to SEQ ID NO: 1110
  antibody sequence

SEQ ID NO: 1113 - DNA, 1404 bp, Artificial; identical to SEQ ID NO: 1109
  antibody sequence

SEQ ID NO: 1114 - DNA, 642 bp, Artificial
  antibody sequence
gagacaaccgtgacccagagccccgccagcctgagcgtggccaccggcgagaaagtgaccatccggtgcatcaccagcaccgacatcgacgacgacatgagctggtatcagcagaagcccggcgagccccccaagctgctgatcagcgagggcaacaccctgcggcctggcgtgcccagcagattcagcagcagcggctgcggcaccgacttcgtgttcaccatcgagaacaccctgagcgaggacgtggccgactactactgcctgcagagcgacaacatgccctacaccttcggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 1115 - DNA, 642 bp, Artificial
  antibody sequence
gacatcgtgatgacccagagccccgccaccctgagcgtgacccctggcgatagagtgtccctgagctgccgggccagccagagcatcagcgactacctgcactggtatcagcagaagtcccacgagagccccagactgctgattaagtacgacagccagtccatcagcggcatccccagcagattcagcggcagcggctccggctccgacttcaccctgagcatcaacagcgtggaacccgaggacgtgggcgtgtactactgccagaacggccaccggttccctttcaccttcggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 1116 - DNA, 657 bp, Artificial
  antibody sequence
aacatcatgatgacccagagccccagcagcctgaccgtgtctgccggcgagaaagtgaccatgagctgcaagagcagccagagcgtgctgtacagctccaaccagaagaactacctggcctggtatcagcagaagcccggccagtcccccaagctgctgatctactgggccagcacccgcgagagcggcgtgcccgatagatttgccggctccggctccggcaccgacttcaccctgagcatcagcagcgtgcaggccgaggacctggccgtgtactactgccaccagtacctgagcagctacaccttcggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 1117 - DNA, 651 bp, Artificial
  antibody sequence
gacatcgtgctgacccagagccctgccagcctggccgtgtctctgggccagagagccaccatcagctaccgggccagcaagagcgtgtccaccagcggctacagctacatgcactggaaccagcagaagcccggccagccccccagactgctgatctacctggtgtccaacctggaaagcggcgtgcccgccagattctccggcagcggctctggcaccgacttcaccctgaacatccaccccgtggaagaagaggacgccgccacctactactgccagcacatcagagagctgaccagaagcgagggcggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 1118 - DNA, 642 bp, Artificial
  antibody sequence
gacatcgtgatgacccagagccccgccaccctgagcgtgacccctggcgatagagtgtccctgagctgccgggccagccagagcatcagcgactacctgcactggtatcagcagaagtcccacgagagccccagactgctgattaagtacgccagccagtccatctccggcatccccagcagattcagcggcagcggctccggcagcgacttcaccctgtccatcaacagcgtggaacccgaggacgtgggcgtgtactactgccagaacggccacagcttccccctgaccttcggcgctggcaccaagctggaactgaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 1119 - DNA, 651 bp, Artificial
  antibody sequence
gacatcgtgctgacccagagccctgccagcctggccgtgtctctgggccagagagccaccatcagctgccaggccagcgagagcgtgtccttcgccggcaccagcctgatgcactggtatcagcagaagcccggccagagccccaagctgctgatctactgggccagcacccgcgagagcggcgtgcccgatagatttgccggctccggctccggcaccgacttcaccctgagcatcagcagcgtgcaggccgaggatctggccgtgtactactgccaccagtacctgagcagctacaccttcggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 1120 - DNA, 705 bp, Artificial
  antibody sequence
atggagacacattctcaggtctttgtatacatgttgctgtggttgtctggtgtcgagggcgagacaaccgtgacccagagccccgccagcctgagcgtggccaccggcgagaaagtgaccatccggtgcatcaccagcaccgacatcgacgacgacatgagctggtatcagcagaagcccggcgagccccccaagctgctgatcagcgagggcaacaccctgcggcctggcgtgcccagcagattcagcagcagcggctgcggcaccgacttcgtgttcaccatcgagaacaccctgagcgaggacgtggccgactactactgcctgcagagcgacaacatgccctacaccttcggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 1121 - DNA, 705 bp, Artificial
  antibody sequence
atggagacacattctcaggtctttgtatacatgttgctgtggttgtctggtgtcgagggcgacatcgtgatgacccagagccccgccaccctgagcgtgacccctggcgatagagtgtccctgagctgccgggccagccagagcatcagcgactacctgcactggtatcagcagaagtcccacgagagccccagactgctgattaagtacgacagccagtccatcagcggcatccccagcagattcagcggcagcggctccggctccgacttcaccctgagcatcaacagcgtggaacccgaggacgtgggcgtgtactactgccagaacggccaccggttccctttcaccttcggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 1122 - DNA, 720 bp, Artificial
  antibody sequence
atggagacacattctcaggtctttgtatacatgttgctgtggttgtctggtgtcgagggcaacatcatgatgacccagagccccagcagcctgaccgtgtctgccggcgagaaagtgaccatgagctgcaagagcagccagagcgtgctgtacagctccaaccagaagaactacctggcctggtatcagcagaagcccggccagtcccccaagctgctgatctactgggccagcacccgcgagagcggcgtgcccgatagatttgccggctccggctccggcaccgacttcaccctgagcatcagcagcgtgcaggccgaggacctggccgtgtactactgccaccagtacctgagcagctacaccttcggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 1123 - DNA, 714 bp, Artificial
  antibody sequence
atggagacacattctcaggtctttgtatacatgttgctgtggttgtctggtgtcgagggcgacatcgtgctgacccagagccctgccagcctggccgtgtctctgggccagagagccaccatcagctaccgggccagcaagagcgtgtccaccagcggctacagctacatgcactggaaccagcagaagcccggccagccccccagactgctgatctacctggtgtccaacctggaaagcggcgtgcccgccagattctccggcagcggctctggcaccgacttcaccctgaacatccaccccgtggaagaagaggacgccgccacctactactgccagcacatcagagagctgaccagaagcgagggcggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 1124 - DNA, 705 bp, Artificial
  antibody sequence
atggagacacattctcaggtctttgtatacatgttgctgtggttgtctggtgtcgagggcgacatcgtgatgacccagagccccgccaccctgagcgtgacccctggcgatagagtgtccctgagctgccgggccagccagagcatcagcgactacctgcactggtatcagcagaagtcccacgagagccccagactgctgattaagtacgccagccagtccatctccggcatccccagcagattcagcggcagcggctccggcagcgacttcaccctgtccatcaacagcgtggaacccgaggacgtgggcgtgtactactgccagaacggccacagcttccccctgaccttcggcgctggcaccaagctggaactgaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 1125 - DNA, 714 bp, Artificial
  antibody sequence
atggagacacattctcaggtctttgtatacatgttgctgtggttgtctggtgtcgagggcgacatcgtgctgacccagagccctgccagcctggccgtgtctctgggccagagagccaccatcagctgccaggccagcgagagcgtgtccttcgccggcaccagcctgatgcactggtatcagcagaagcccggccagagccccaagctgctgatctactgggccagcacccgcgagagcggcgtgcccgatagatttgccggctccggctccggcaccgacttcaccctgagcatcagcagcgtgcaggccgaggatctggccgtgtactactgccaccagtacctgagcagctacaccttcggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 1126 - DNA, 1344 bp, Artificial
  antibody sequence
gaagtgaagctggtggaatctggcggcgacctggtcaagcctggcggcagcctgaagctgagctgcgccgccagcggcttcaccttcagcagcttcgccatgagctgggtccgacagacccccgagaagcggctggaatgggtggccagcatcagccggaccgacaacacctactaccccgacagcatgaagggccagttcaccatcagccgggacaacgcccggaacatcctgtacctgcagatgagcagcctgcggagcgagaacaccgccatctactactgcgccagagccgactacgacggcccttggtttgcctactggggccagggcaccctggtcaccgtgtctgctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaa

SEQ ID NO: 1127 - DNA, 1338 bp, Artificial
  antibody sequence
gaggtgcagctgcagcagagcggccctgatctggtcaagcccggcaccagcgtgaagatgagctgcaaggccagcggctacagcttcaccggctactacatgcactgggtcaagcagagccacggcaagagcctggaatggatcggcagagtgaaccccaacaacggcggcaccagctacaaccagaagttcaagggcaaggccatcctgaccgtggacaagagcagcagcaccgcctacatggaactgcggagcctgaccagcgaggacagcgccgtgtactactgcgccagggacgactacagcttcgcctactggggccagggcaccctggtcaccgtgtctgctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaa

SEQ ID NO: 1128 - DNA, 1344 bp, Artificial
  antibody sequence
gaagtgaagctggtggaaagcggcggaggcctggtgcagcctggcggcagcctgagactgagctgcgccaccagcggcttcaccttcaccgacttctacatgagctgggtccgacagccccctggcaaggccctggaatggctggccttcatccggaacaaggccaacggctacaccaccgagtacagcagcagcgtgcggggcagattcaccatcagccgggacaacagccagagcatcctgtacctgcagatgaacaccctgcgggccgaggacagcggcacctactactgcgccagggacgtgggcgactacgactactggggccagggcagcaccctgaccgtgtcctctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaa

SEQ ID NO: 1129 - DNA, 1347 bp, Artificial
  antibody sequence
cagatccagctggtgcagagcggccctgagctgaagaaacccggcgagacagtgaagatcagctgcaaggccagcggcttcaccttcaccaactacggcatgaactgggtcaagcaggcccctggcaaggacctgaagtggatgggctggatcaacacctacaccggcgagcccacctacgccgacgacttcaagggcagattcgccttcagcctggaaaccagcgccagcaccgcctacctgcagatcaacaacctgaaggacgaggataccgccagctacttctgcgccagagactaccgggacggcgacgccctggattactggggccagggcaccagcgtgaccgtgtcctctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaa

SEQ ID NO: 1130 - DNA, 1338 bp, Artificial
  antibody sequence
caggtgcagctgcagcagcctggcgccgaactcgtcagacctggcgccagcgtgaagctgagctgcaaggccagcggctacagcttcaccagcaactggatgaattggatgaagcagcggcctggccagggcctggaatggatcggcatgatccaccccagcgacagcgagagccggctgaaccagaagttcaaggacaaggccaccctgaccgtggacaagagcagcagcaccgcctacatgcagctgtccagccccaccagcgaggacagcgccgtgtactactgtgccagaggcgacggcggcttcgcctactggggacagggcaccctggtcaccgtgtccgctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaa

SEQ ID NO: 1131 - DNA, 1344 bp, Artificial
  antibody sequence
gaagtgaagctgcagcagagcggccctgagctggtcaagcctggcgccagcatgaagatcagctgcaaggccagcggctacagcttcaccggctacaccatgaactgggccaagcagagccacggcaagaacctggaatggatcggcctgatcaacccctacaacggcggcaccagctacaaccagaagttcaagggcaaggccaccctgaccgtggacaagagcagcagcaccgcctacatggaactgctgagcctgaccagcgaggacagcgccgtgtactactgcgccagaggctaccccagaggatggttcgcctactggggccagggcaccctggtcaccgtgtctgctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaa

SEQ ID NO: 1132 - DNA, 1359 bp, Artificial
  antibody sequence
gacgtgaagctggtggaaagcggcggaggcctggtcaagcctggcggcagcctgaagctgagctgcgccgccagcggcttcaccttccggaaccacgccatgagctgggtccgacagacccccgagaagcggctggaatgggtggccgccatcaacgtgaacgccggcagcacctactaccccgacaccgtgaaggaccggttcaccatcagccgggacaacgccaagaacaccctgtacctgcagatgagcagcctgcggagcgaggacaccgccctgtactactgcgccagacaccgggcctactacaactacgacgagaacgccatggactactggggccagggcaccagcgtgaccgtgtcctctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaa

SEQ ID NO: 1133 - DNA, 1344 bp, Artificial
  antibody sequence
gaggtgcagctgcagcagagcggccctgagctggtcaagcccggcgacagcgtgaagatgagctgcaaggccagcggctacaccttcaccgactactacatcgactggatgaagcagagccacggcaagagcctggaatggatcggctacatctaccccaacaacggcggcaccagctacaaccagaacttcaaggacaaggccaccctgaccgtggacaagagcagcagcaccgcctacatggaactgcacagcctgaccagcgaggacagcgccgtgtactactgcgccagactgacctactacgccaaggtggacagctggggccagggcaccagcgtgaccgtgtctagcgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaa

SEQ ID NO: 1134 - DNA, 1335 bp, Artificial
  antibody sequence
gacgtgaagctggtggaaagcggcggaggcctggtggaatgggagggcgtgctgaagctgagctgcgccgccagcggcttcaccttcagcagctacgccatgagctgggtccgacagacccccgagaagcggctggaatgggtggccgccatcaacagcaacggcggcagcacctactaccccgacaccgtgaaggaccggttcaccatcagccgggacaacgccaagaacaccctgtacctgcagatgagcagcctgcggagcgaggacaccgccctgtactactgcgccagactgtactacggcgactactggggccagggcaccaccctgaccgtgtcctctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaa

SEQ ID NO: 1135 - DNA, 1323 bp, Artificial
  antibody sequence
caggtgcagctgaagcagagcggccctagcctggtgcagcccagccagagcctgagcatcacctgtaccgtgtccggcttcagcctgaccacctacggcctgcactggatccggcagagccccggcaagggcctggaatggctgggagtgatttggagaggcggcaccaccgactacaacgccgccttcatgagccggctgaccatcaccaaggacaacagcaagagccaggtgttcttcaagatgaacagcctgcaggccgacgacaccgccatctactactgcgcccggaccgacatctggggcgctggcaccaccgtgaccgtgtcctctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaa

SEQ ID NO: 1136 - DNA, 1323 bp, Artificial; identical to SEQ ID NO: 1135
  antibody sequence

SEQ ID NO: 1137 - DNA, 1323 bp, Artificial; identical to SEQ ID NO: 1135
  antibody sequence

SEQ ID NO: 1138 - DNA, 1323 bp, Artificial
  antibody sequence
caggtgcagctgaagcagagcggccctggcctggtgcagcctagccagagcctgcccatcacctgtaccgtgtccggcttcagcctgaccacctacggcctgcactggatccggcagagccccggcaagggcctggaatggctgggagtgatttggagaggcggcaccaccgactacaacgccgccttcatgagccggctgaccatcaccaaggacaacagcaagagccaggtgttcttcaagatgaacagcctgcaggccgacgacaccgccatctactactgcgcccggaccgacatctggggcgctggcaccaccgtgaccgtgtcctctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaa

SEQ ID NO: 1139 - DNA, 1323 bp, Artificial
  antibody sequence
caggtgcagctgaagcagagcggccctggcctggtgcagcctagccagagcctgagcatcacctgtaccgtgtccggcttcagcctgaccacctacggcctgcactggatccggcagagccccggcaagggcctggaatggctgggagtgatttggagaggcggcaccaccgactacaacgccgccttcatgagccggctgaccatcaccaaggacaacagcaagagccaggtgttcttcaagatgaacagcctgcaggccgacgacaccgccatctactactgcgcccggaccgacatctggggcgctggcaccaccgtgaccgtgtcctctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaa

SEQ ID NO: 1140 - DNA, 1323 bp, Artificial; identical to SEQ ID NO: 1135
  antibody sequence

SEQ ID NO: 1141 - DNA, 1323 bp, Artificial
  antibody sequence
caggtgcagctgaagcagagcggccctggcctggtgcagcctagccagagcctgagcatcacctgtaccgtgtccggcttcagcctgaccagctacggcgtgcactgggtccgacagcctcccggcaagggcctggaatggctgggagtgatttggagcggcggcatcaccgactacaacgccgccttcatcagcagactgagcatcagcaaggacaacagcaagagccaggtgttcttcaagatgaacagcctgcaggccgacgacaccgccatctactactgcgccagaaccgacctgtggggccagggcaccctggtcacagtgtctgccgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaa

SEQ ID NO: 1142 - DNA, 1350 bp, Artificial
  antibody sequence
caggtgcagctgcagcagtctggcgccgagctgatgaaccctggcgccagcgtgaagatcagctgcaagagcaccggctacaagttcagcagctactggatcgagtgggtcaagcagcggcctggccacggcctggaatggatgggcgagatcctgcctggcagcggcagcaccaaccacaacgagaagttcaagggcaaggccatcttcaccgccgacgccagcagcaacaccgcctacatggaactgagcagcctgaccagcgaggacagcgccgtgtactactgcgcccggaccatcagcaccgccaccgattggttcgcctactggggccagggcaccctggtcaccgtgtctgctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaa

SEQ ID NO: 1143 - DNA, 1350 bp, Artificial; identical to SEQ ID NO: 1142
  antibody sequence

SEQ ID NO: 1144 - DNA, 1350 bp, Artificial
  antibody sequence
caggtgcagctgcagcagtctggcgccgagctgatgaagcctggcgccagcgtgaagatgagctgcaaggccaccggctacaagttcagcagctactggatcgagtgggtcaagcagcggcctggccacggcctggaatggatgggcgagatcctgcctggcagcggcagcaccaaccacaacgagaagttcaagggcaaggccatcttcaccgccgacgccagcagcaacaccgcctacatggaactgagcagcctgaccagcgaggacagcgccgtgtactactgcgcccggaccatcagcaccgccaccgattggttcgcctactggggccagggcaccctggtcaccgtgtctgctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaa

SEQ ID NO: 1145 - DNA, 1350 bp, Artificial
  antibody sequence
caggtgcagctgcagcagtctggcgccgagctgatgaagcctggcgccagcgtgaagatgagctgcaaggccaccggctacaagttcagcagctactggatcgagtgggtcaagcagcggcctggccacggcctggaatggatgggcgagatcctgcctggcagcggcagcaccaaccacaacgagaagttcaccggcagagccatcttcaccgccgacgccagcagcaacaccgcctacatggaactgagcagcctgaccagcgaggacagcgccgtgtactactgcgcccggaccatcagcaccgccaccgattggttcgcctactggggccagggcaccctggtcaccgtgtctgctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaa

SEQ ID NO: 1146 - DNA, 1350 bp, Artificial; identical to SEQ ID NO: 1144
  antibody sequence

SEQ ID NO: 1147 - DNA, 1350 bp, Artificial
  antibody sequence
caggtgcagctgcagcagtctggcgccgagctgatgaagcctggcgccagcgtgaagatgccctgcaaggccaccggctacaagttcagcagctactggatcgagtgggtcaagcagcggcctggccacggcctggaatggatgggcgagatcctgcctggcagcggcagcaccaaccacaacgagaagttcaagggcaaggccatcttcaccgccgacgccagcagcaacaccgcctacatggaactgagcagcctgaccagcgaggacagcgccgtgtactactgcgcccggaccatcagcaccgccaccgattggttcgcctactggggccagggcaccctggtcaccgtgtctgctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaa

SEQ ID NO: 1148 - DNA, 1341 bp, Artificial
  antibody sequence
gaggtgcagctgcagcagtctggcgctgaactcgtgcggcctggcgccctggtcaagctgagctgcaaggccagcggcttcaacatcaaggactactacatgcactgggtcaagcagcggcccgagcagggcctggaatggatcggctggatcgaccccgagaacggcaacaccatctacgaccccaagttccagggcaaggcctccatcaccgccgacaccagcagcaacaccgcctacctgcagctgagcagcctgaccagcgaggacaccgccgtgtactactgcgccagatacgacggctacgccatggactactggggccagggcaccagcgtgaccgtgtcctctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaa

SEQ ID NO: 1149 - DNA, 1326 bp, Artificial
  antibody sequence
caggtgcagctgcagcagtctggcgctgaactcgtgcggcctggcaccagcgtgaagatgagctgcaaggccgctggctacaccttcaccaactactggatcggctgggtcaagcagcggcctggccacggcctggaatggatcggcgacatctaccctggcggcggatacaccaactacaacgagaagttcaaggacaagaccaccctgaccgccgacaccagcagcaacaccgcctacatgcagctgagcagcctgaccagcgaggacagcgccatctactactgcgccagcaacgactgctggggccagggcaccacactgaccgtgtccagcgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaa

SEQ ID NO: 1150 - DNA, 1347 bp, Artificial
  antibody sequence
caggtgcagctgaagcagagcggccctggcctggtgcagcctagccagagcctgagcatcacctgtaccgtgtccggcttcagcatcaccagctacggcgtgcactggatccggcagagccccggcaagggcctggaatggctgggagtgatttggagcggcggcagcaccgactacaacgccgccttcatcagcagactgagcatcagcgaggacaacagcaagagccaggtgttcttcaagatgaacagcctgcaggccaacgacaccgccatctactactgcgccaccttctactacgactacgacgagggcttcgactactggggccagggcaccaccctgaccgtgtcctctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaa

SEQ ID NO: 1151 - DNA, 1347 bp, Artificial
  antibody sequence
caggtgcagctgaagcagagcggccctggcctggtgcagcctagccagagcctgagcatcacctgtaccgtgtccggcttcagcatcaccagctacggcgtgcactggatccggcagagccccggcaagggcctggaatggctgggagtgatttggagcggcggcagcaccgactacaacgccgccttcatcagcagactgagcatcagcaaggacaacagcaagagccaggtgttcttcaagatgaacagcctgcaggccaacgacaccgccatctactactgcgccaccttctactacgactacgacgagggcttcgactactggggccagggcaccaccctgaccgtgtcctctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaa

SEQ ID NO: 1152 - DNA, 1347 bp, Artificial; identical to SEQ ID NO: 1151
  antibody sequence

SEQ ID NO: 1153 - DNA, 1347 bp, Artificial; identical to SEQ ID NO: 1151
  antibody sequence

SEQ ID NO: 1154 - DNA, 1347 bp, Artificial; identical to SEQ ID NO: 1151
  antibody sequence

SEQ ID NO: 1155 - DNA, 1347 bp, Artificial; identical to SEQ ID NO: 1151
  antibody sequence

SEQ ID NO: 1156 - DNA, 1347 bp, Artificial
  antibody sequence
caggtgcagctgaaagagtccggccctggactggtggcccccagccagagcctgagcatcacctgtaccgtgtccggcctgagcctgaccagctacggcctgtcttgggtccgacagccccctggcaagggcctggaatggctgggagtgatctggggcgacggcagcaccaactaccacagcgccctgatcagcagactgagcatcagcaaggacaacagcaagagccaggtgttcctgaagctgaacagcctgcagagcgacgacaccgccacctactactgcgccaccagaggcgactacggcagctacgccatggactactggggccagggcaccagcgtgaccgtgtcctctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaa

SEQ ID NO: 1157 - DNA, 1338 bp, Artificial
  antibody sequence
gaggtgcagctgcagcagtctggcgctgaactcgtgcggcctggcgccagcgtgaagctgagctgtaccgccagcggcttcaacatcaaggacagcctgatccactgggtcaagcagcggcccgagcagggcctggaatggatcggctggatcgaccccgaggacggcgagactaagtacgcccccaagttccaggacaaggccgccctgaccaccgacaccagcagcaacaccgcctacctgcacctgaacagcctgaccagcgaggacaccgccatctactactgcggcagaggcggcctgatcctggactactggggccagggcaccaccctgaccgtgtcctctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaa

SEQ ID NO: 1158 - DNA, 1347 bp, Artificial
  antibody sequence
cagatccagctggtgcagagcggccctgagctgaagaaacccggcgagacagtgaagatcagctgcagaagcagcggctacaccttcaccaactacggcctgaactgggtcaagcaggcccctggcaaggacctgaagtggatgggctggctgaacacctacaccggcgagcccacctacgccgacgacttcaagggcagattcgccttcagcctggaaaccagcgccggcaccgcctacctgcagatcaacaacctgaagaacgaggacaccgccacctacttttgctcccgggactaccgcgagggcgacgccatggattactggtcccagggcaccagcgtgaccgtgtccagcgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaa

SEQ ID NO: 1159 - DNA, 1344 bp, Artificial
  antibody sequence
gaggtgcagctggtggaaagcggcggaggactggtcaagcctggcggcagcctgaagctgagctgcgccgccagcggcttcaccttcagcagctacgccatgagctgggtccgacagacccccgagaagcggctggaatgggtggccaccatcagcaccagcggcagctacacctactaccgggacagcgtgaagggccggctgaccatcagccgggacaacgccaagaacaccctgtacctgcagatgaccagcctgcggagcgaggacaccgccatgtactactgcacccggcacggcgaccacgacggcttcgattactggggccagggcaccaccctgaccgtgtcctctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaa

SEQ ID NO: 1160 - DNA, 1344 bp, Artificial
  antibody sequence
gaggtgcagctggtggaaagcggcggaggactggtcaagcctggcggcagcctgaagctgagctgcgtggcctccggcttcagcttcagcaactacgccatgagctgggtccgacagacccccgagcggagactggaatgggtggccaccatcaacagcggcggcagcttcagctttttcccagactccgtgaagggccggttcaccatcagccgggacagcgccaagaacaccctgtacctgcagatgagcagcctgcggagcgacgacaccgccatgtactactgcacccggcactgggaccacccttggtttgcctactggggccagggcaccctggtcaccgtgtctgctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaa

SEQ ID NO: 1161 - DNA, 1344 bp, Artificial; identical to SEQ ID NO: 1160
  antibody sequence

SEQ ID NO: 1162 - DNA, 1344 bp, Artificial; identical to SEQ ID NO: 1160
  antibody sequence

SEQ ID NO: 1163 - DNA, 1332 bp, Artificial
  antibody sequence
gaggtgcagctgcagcagtctggcgctgaactcgtgcggcctggcgccagcgtgaagctgagctgcaccaccagcggcttcaacatcaaggacagcctgatctactgggtcaagcagcggcccgagcagggcctggaatggatcggctggatcgaccccgaggacggcgagacaaagttcgcccccagattccaggacaaggccaccatcaccagcgacaccagcagcaacaccgcctacctgcggctgagcagcctgaccagcaaggacaccgccatctactactgcacccggtccttcggcgtgtgctggggccagggcaccctggtcacagtgtctgccgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaa

SEQ ID NO: 1164 - DNA, 1332 bp, Artificial
  antibody sequence
gaggtgcagctgcagcagtctggcgctgaactcgtgcggcctggcgccagcgtgaagctgagctgcaccaccagcggcttcaacatcaaggacagcctgatctactgggtcaagcagcggcccgagcagggcctggaatggatcggctggatcgaccccgaggacggcgagacaaagttcgcccccagattccaggacaaggccaccatcaccagcgacaccagcagcaacaccgcctacctgcggctgagcagcctgaccagcgaggacaccgccatctactactgcacccggtccttcggcgtgtgctggggccagggcaccctggtcacagtgtctgccgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaa

SEQ ID NO: 1165 - DNA, 1404 bp, Artificial
  antibody sequence
atggcttgggtgtggaccttgctattcctgatggcagctgcccaaagtatacaggccgaagtgaagctggtggaatctggcggcgacctggtcaagcctggcggcagcctgaagctgagctgcgccgccagcggcttcaccttcagcagcttcgccatgagctgggtccgacagacccccgagaagcggctggaatgggtggccagcatcagccggaccgacaacacctactaccccgacagcatgaagggccagttcaccatcagccgggacaacgcccggaacatcctgtacctgcagatgagcagcctgcggagcgagaacaccgccatctactactgcgccagagccgactacgacggcccttggtttgcctactggggccagggcaccctggtcaccgtgtctgctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatga

SEQ ID NO: 1166 - DNA, 1398 bp, Artificial
  antibody sequence
atggcttgggtgtggaccttgctattcctgatggcagctgcccaaagtatacaggccgaggtgcagctgcagcagagcggccctgatctggtcaagcccggcaccagcgtgaagatgagctgcaaggccagcggctacagcttcaccggctactacatgcactgggtcaagcagagccacggcaagagcctggaatggatcggcagagtgaaccccaacaacggcggcaccagctacaaccagaagttcaagggcaaggccatcctgaccgtggacaagagcagcagcaccgcctacatggaactgcggagcctgaccagcgaggacagcgccgtgtactactgcgccagggacgactacagcttcgcctactggggccagggcaccctggtcaccgtgtctgctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatga

SEQ ID NO: 1167 - DNA, 1404 bp, Artificial
  antibody sequence
atggcttgggtgtggaccttgctattcctgatggcagctgcccaaagtatacaggccgaagtgaagctggtggaaagcggcggaggcctggtgcagcctggcggcagcctgagactgagctgcgccaccagcggcttcaccttcaccgacttctacatgagctgggtccgacagccccctggcaaggccctggaatggctggccttcatccggaacaaggccaacggctacaccaccgagtacagcagcagcgtgcggggcagattcaccatcagccgggacaacagccagagcatcctgtacctgcagatgaacaccctgcgggccgaggacagcggcacctactactgcgccagggacgtgggcgactacgactactggggccagggcagcaccctgaccgtgtcctctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatga

SEQ ID NO: 1168 - DNA, 1407 bp, Artificial
  antibody sequence
atggcttgggtgtggaccttgctattcctgatggcagctgcccaaagtatacaggcccagatccagctggtgcagagcggccctgagctgaagaaacccggcgagacagtgaagatcagctgcaaggccagcggcttcaccttcaccaactacggcatgaactgggtcaagcaggcccctggcaaggacctgaagtggatgggctggatcaacacctacaccggcgagcccacctacgccgacgacttcaagggcagattcgccttcagcctggaaaccagcgccagcaccgcctacctgcagatcaacaacctgaaggacgaggataccgccagctacttctgcgccagagactaccgggacggcgacgccctggattactggggccagggcaccagcgtgaccgtgtcctctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatga

SEQ ID NO: 1169 - DNA, 1398 bp, Artificial
  antibody sequence
atggcttgggtgtggaccttgctattcctgatggcagctgcccaaagtatacaggcccaggtgcagctgcagcagcctggcgccgaactcgtcagacctggcgccagcgtgaagctgagctgcaaggccagcggctacagcttcaccagcaactggatgaattggatgaagcagcggcctggccagggcctggaatggatcggcatgatccaccccagcgacagcgagagccggctgaaccagaagttcaaggacaaggccaccctgaccgtggacaagagcagcagcaccgcctacatgcagctgtccagccccaccagcgaggacagcgccgtgtactactgtgccagaggcgacggcggcttcgcctactggggacagggcaccctggtcaccgtgtccgctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatga

SEQ ID NO: 1170 - DNA, 1404 bp, Artificial
  antibody sequence
atggcttgggtgtggaccttgctattcctgatggcagctgcccaaagtatacaggccgaagtgaagctgcagcagagcggccctgagctggtcaagcctggcgccagcatgaagatcagctgcaaggccagcggctacagcttcaccggctacaccatgaactgggccaagcagagccacggcaagaacctggaatggatcggcctgatcaacccctacaacggcggcaccagctacaaccagaagttcaagggcaaggccaccctgaccgtggacaagagcagcagcaccgcctacatggaactgctgagcctgaccagcgaggacagcgccgtgtactactgcgccagaggctaccccagaggatggttcgcctactggggccagggcaccctggtcaccgtgtctgctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatga

SEQ ID NO: 1171 - DNA, 1419 bp, Artificial
  antibody sequence
atggcttgggtgtggaccttgctattcctgatggcagctgcccaaagtatacaggccgacgtgaagctggtggaaagcggcggaggcctggtcaagcctggcggcagcctgaagctgagctgcgccgccagcggcttcaccttccggaaccacgccatgagctgggtccgacagacccccgagaagcggctggaatgggtggccgccatcaacgtgaacgccggcagcacctactaccccgacaccgtgaaggaccggttcaccatcagccgggacaacgccaagaacaccctgtacctgcagatgagcagcctgcggagcgaggacaccgccctgtactactgcgccagacaccgggcctactacaactacgacgagaacgccatggactactggggccagggcaccagcgtgaccgtgtcctctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatga

SEQ ID NO: 1172 - DNA, 1404 bp, Artificial
  antibody sequence
atggcttgggtgtggaccttgctattcctgatggcagctgcccaaagtatacaggccgaggtgcagctgcagcagagcggccctgagctggtcaagcccggcgacagcgtgaagatgagctgcaaggccagcggctacaccttcaccgactactacatcgactggatgaagcagagccacggcaagagcctggaatggatcggctacatctaccccaacaacggcggcaccagctacaaccagaacttcaaggacaaggccaccctgaccgtggacaagagcagcagcaccgcctacatggaactgcacagcctgaccagcgaggacagcgccgtgtactactgcgccagactgacctactacgccaaggtggacagctggggccagggcaccagcgtgaccgtgtctagcgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatga

SEQ ID NO: 1173 - DNA, 1395 bp, Artificial
  antibody sequence
atggcttgggtgtggaccttgctattcctgatggcagctgcccaaagtatacaggccgacgtgaagctggtggaaagcggcggaggcctggtggaatgggagggcgtgctgaagctgagctgcgccgccagcggcttcaccttcagcagctacgccatgagctgggtccgacagacccccgagaagcggctggaatgggtggccgccatcaacagcaacggcggcagcacctactaccccgacaccgtgaaggaccggttcaccatcagccgggacaacgccaagaacaccctgtacctgcagatgagcagcctgcggagcgaggacaccgccctgtactactgcgccagactgtactacggcgactactggggccagggcaccaccctgaccgtgtcctctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatga

SEQ ID NO: 1174 - DNA, 1383 bp, Artificial
  antibody sequence
atggcttgggtgtggaccttgctattcctgatggcagctgcccaaagtatacaggcccaggtgcagctgaagcagagcggccctagcctggtgcagcccagccagagcctgagcatcacctgtaccgtgtccggcttcagcctgaccacctacggcctgcactggatccggcagagccccggcaagggcctggaatggctgggagtgatttggagaggcggcaccaccgactacaacgccgccttcatgagccggctgaccatcaccaaggacaacagcaagagccaggtgttcttcaagatgaacagcctgcaggccgacgacaccgccatctactactgcgcccggaccgacatctggggcgctggcaccaccgtgaccgtgtcctctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatga

SEQ ID NO: 1175 - DNA, 1383 bp, Artificial; identical to SEQ ID NO: 1174
  antibody sequence

SEQ ID NO: 1176 - DNA, 1383 bp, Artificial; identical to SEQ ID NO: 1174
  antibody sequence

SEQ ID NO: 1177 - DNA, 1383 bp, Artificial
  antibody sequence
atggcttgggtgtggaccttgctattcctgatggcagctgcccaaagtatacaggcccaggtgcagctgaagcagagcggccctggcctggtgcagcctagccagagcctgcccatcacctgtaccgtgtccggcttcagcctgaccacctacggcctgcactggatccggcagagccccggcaagggcctggaatggctgggagtgatttggagaggcggcaccaccgactacaacgccgccttcatgagccggctgaccatcaccaaggacaacagcaagagccaggtgttcttcaagatgaacagcctgcaggccgacgacaccgccatctactactgcgcccggaccgacatctggggcgctggcaccaccgtgaccgtgtcctctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatga

SEQ ID NO: 1178 - DNA, 1383 bp, Artificial
  antibody sequence
atggcttgggtgtggaccttgctattcctgatggcagctgcccaaagtatacaggcccaggtgcagctgaagcagagcggccctggcctggtgcagcctagccagagcctgagcatcacctgtaccgtgtccggcttcagcctgaccacctacggcctgcactggatccggcagagccccggcaagggcctggaatggctgggagtgatttggagaggcggcaccaccgactacaacgccgccttcatgagccggctgaccatcaccaaggacaacagcaagagccaggtgttcttcaagatgaacagcctgcaggccgacgacaccgccatctactactgcgcccggaccgacatctggggcgctggcaccaccgtgaccgtgtcctctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatga

SEQ ID NO: 1179 - DNA, 1383 bp, Artificial; identical to SEQ ID NO: 1174
  antibody sequence

SEQ ID NO: 1180 - DNA, 1383 bp, Artificial
  antibody sequence
atggcttgggtgtggaccttgctattcctgatggcagctgcccaaagtatacaggcccaggtgcagctgaagcagagcggccctggcctggtgcagcctagccagagcctgagcatcacctgtaccgtgtccggcttcagcctgaccagctacggcgtgcactgggtccgacagcctcccggcaagggcctggaatggctgggagtgatttggagcggcggcatcaccgactacaacgccgccttcatcagcagactgagcatcagcaaggacaacagcaagagccaggtgttcttcaagatgaacagcctgcaggccgacgacaccgccatctactactgcgccagaaccgacctgtggggccagggcaccctggtcacagtgtctgccgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatga

SEQ ID NO: 1181 - DNA, 1410 bp, Artificial
  antibody sequence
atggcttgggtgtggaccttgctattcctgatggcagctgcccaaagtatacaggcccaggtgcagctgcagcagtctggcgccgagctgatgaaccctggcgccagcgtgaagatcagctgcaagagcaccggctacaagttcagcagctactggatcgagtgggtcaagcagcggcctggccacggcctggaatggatgggcgagatcctgcctggcagcggcagcaccaaccacaacgagaagttcaagggcaaggccatcttcaccgccgacgccagcagcaacaccgcctacatggaactgagcagcctgaccagcgaggacagcgccgtgtactactgcgcccggaccatcagcaccgccaccgattggttcgcctactggggccagggcaccctggtcaccgtgtctgctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatga

SEQ ID NO: 1182 - DNA, 1410 bp, Artificial; identical to SEQ ID NO: 1181
  antibody sequence

SEQ ID NO: 1183 - DNA, 1410 bp, Artificial
  antibody sequence
atggcttgggtgtggaccttgctattcctgatggcagctgcccaaagtatacaggcccaggtgcagctgcagcagtctggcgccgagctgatgaagcctggcgccagcgtgaagatgagctgcaaggccaccggctacaagttcagcagctactggatcgagtgggtcaagcagcggcctggccacggcctggaatggatgggcgagatcctgcctggcagcggcagcaccaaccacaacgagaagttcaagggcaaggccatcttcaccgccgacgccagcagcaacaccgcctacatggaactgagcagcctgaccagcgaggacagcgccgtgtactactgcgcccggaccatcagcaccgccaccgattggttcgcctactggggccagggcaccctggtcaccgtgtctgctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatga

SEQ ID NO: 1184 - DNA, 1410 bp, Artificial
  antibody sequence
atggcttgggtgtggaccttgctattcctgatggcagctgcccaaagtatacaggcccaggtgcagctgcagcagtctggcgccgagctgatgaagcctggcgccagcgtgaagatgagctgcaaggccaccggctacaagttcagcagctactggatcgagtgggtcaagcagcggcctggccacggcctggaatggatgggcgagatcctgcctggcagcggcagcaccaaccacaacgagaagttcaccggcagagccatcttcaccgccgacgccagcagcaacaccgcctacatggaactgagcagcctgaccagcgaggacagcgccgtgtactactgcgcccggaccatcagcaccgccaccgattggttcgcctactggggccagggcaccctggtcaccgtgtctgctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatga

SEQ ID NO: 1185 - DNA, 1410 bp, Artificial; identical to SEQ ID NO: 1183
  antibody sequence

SEQ ID NO: 1186 - DNA, 1410 bp, Artificial
  antibody sequence
atggcttgggtgtggaccttgctattcctgatggcagctgcccaaagtatacaggcccaggtgcagctgcagcagtctggcgccgagctgatgaagcctggcgccagcgtgaagatgccctgcaaggccaccggctacaagttcagcagctactggatcgagtgggtcaagcagcggcctggccacggcctggaatggatgggcgagatcctgcctggcagcggcagcaccaaccacaacgagaagttcaagggcaaggccatcttcaccgccgacgccagcagcaacaccgcctacatggaactgagcagcctgaccagcgaggacagcgccgtgtactactgcgcccggaccatcagcaccgccaccgattggttcgcctactggggccagggcaccctggtcaccgtgtctgctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatga

SEQ ID NO: 1187 - DNA, 1401 bp, Artificial
  antibody sequence
atggcttgggtgtggaccttgctattcctgatggcagctgcccaaagtatacaggccgaggtgcagctgcagcagtctggcgctgaactcgtgcggcctggcgccctggtcaagctgagctgcaaggccagcggcttcaacatcaaggactactacatgcactgggtcaagcagcggcccgagcagggcctggaatggatcggctggatcgaccccgagaacggcaacaccatctacgaccccaagttccagggcaaggcctccatcaccgccgacaccagcagcaacaccgcctacctgcagctgagcagcctgaccagcgaggacaccgccgtgtactactgcgccagatacgacggctacgccatggactactggggccagggcaccagcgtgaccgtgtcctctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatga

SEQ ID NO: 1188 - DNA, 1386 bp, Artificial
  antibody sequence
atggcttgggtgtggaccttgctattcctgatggcagctgcccaaagtatacaggcccaggtgcagctgcagcagtctggcgctgaactcgtgcggcctggcaccagcgtgaagatgagctgcaaggccgctggctacaccttcaccaactactggatcggctgggtcaagcagcggcctggccacggcctggaatggatcggcgacatctaccctggcggcggatacaccaactacaacgagaagttcaaggacaagaccaccctgaccgccgacaccagcagcaacaccgcctacatgcagctgagcagcctgaccagcgaggacagcgccatctactactgcgccagcaacgactgctggggccagggcaccacactgaccgtgtccagcgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatga

SEQ ID NO: 1189 - DNA, 1407 bp, Artificial
  antibody sequence
atggcttgggtgtggaccttgctattcctgatggcagctgcccaaagtatacaggcccaggtgcagctgaagcagagcggccctggcctggtgcagcctagccagagcctgagcatcacctgtaccgtgtccggcttcagcatcaccagctacggcgtgcactggatccggcagagccccggcaagggcctggaatggctgggagtgatttggagcggcggcagcaccgactacaacgccgccttcatcagcagactgagcatcagcgaggacaacagcaagagccaggtgttcttcaagatgaacagcctgcaggccaacgacaccgccatctactactgcgccaccttctactacgactacgacgagggcttcgactactggggccagggcaccaccctgaccgtgtcctctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatga

SEQ ID NO: 1190 - DNA, 1407 bp, Artificial
  antibody sequence
atggcttgggtgtggaccttgctattcctgatggcagctgcccaaagtatacaggcccaggtgcagctgaagcagagcggccctggcctggtgcagcctagccagagcctgagcatcacctgtaccgtgtccggcttcagcatcaccagctacggcgtgcactggatccggcagagccccggcaagggcctggaatggctgggagtgatttggagcggcggcagcaccgactacaacgccgccttcatcagcagactgagcatcagcaaggacaacagcaagagccaggtgttcttcaagatgaacagcctgcaggccaacgacaccgccatctactactgcgccaccttctactacgactacgacgagggcttcgactactggggccagggcaccaccctgaccgtgtcctctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatga

SEQ ID NO: 1191 - DNA, 1407 bp, Artificial; identical to SEQ ID NO: 1190
  antibody sequence

SEQ ID NO: 1192 - DNA, 1407 bp, Artificial; identical to SEQ ID NO: 1190
  antibody sequence

SEQ ID NO: 1193 - DNA, 1407 bp, Artificial; identical to SEQ ID NO: 1190
  antibody sequence

SEQ ID NO: 1194 - DNA, 1407 bp, Artificial; identical to SEQ ID NO: 1190
  antibody sequence

SEQ ID NO: 1195 - DNA, 1407 bp, Artificial
  antibody sequence
atggcttgggtgtggaccttgctattcctgatggcagctgcccaaagtatacaggcccaggtgcagctgaaagagtccggccctggactggtggcccccagccagagcctgagcatcacctgtaccgtgtccggcctgagcctgaccagctacggcctgtcttgggtccgacagccccctggcaagggcctggaatggctgggagtgatctggggcgacggcagcaccaactaccacagcgccctgatcagcagactgagcatcagcaaggacaacagcaagagccaggtgttcctgaagctgaacagcctgcagagcgacgacaccgccacctactactgcgccaccagaggcgactacggcagctacgccatggactactggggccagggcaccagcgtgaccgtgtcctctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatga

SEQ ID NO: 1196 - DNA, 1398 bp, Artificial
  antibody sequence
atggcttgggtgtggaccttgctattcctgatggcagctgcccaaagtatacaggccgaggtgcagctgcagcagtctggcgctgaactcgtgcggcctggcgccagcgtgaagctgagctgtaccgccagcggcttcaacatcaaggacagcctgatccactgggtcaagcagcggcccgagcagggcctggaatggatcggctggatcgaccccgaggacggcgagactaagtacgcccccaagttccaggacaaggccgccctgaccaccgacaccagcagcaacaccgcctacctgcacctgaacagcctgaccagcgaggacaccgccatctactactgcggcagaggcggcctgatcctggactactggggccagggcaccaccctgaccgtgtcctctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatga

SEQ ID NO: 1197 - DNA, 1407 bp, Artificial
  antibody sequence
atggcttgggtgtggaccttgctattcctgatggcagctgcccaaagtatacaggcccagatccagctggtgcagagcggccctgagctgaagaaacccggcgagacagtgaagatcagctgcagaagcagcggctacaccttcaccaactacggcctgaactgggtcaagcaggcccctggcaaggacctgaagtggatgggctggctgaacacctacaccggcgagcccacctacgccgacgacttcaagggcagattcgccttcagcctggaaaccagcgccggcaccgcctacctgcagatcaacaacctgaagaacgaggacaccgccacctacttttgctcccgggactaccgcgagggcgacgccatggattactggtcccagggcaccagcgtgaccgtgtccagcgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatga

SEQ ID NO: 1198 - DNA, 1404 bp, Artificial
  antibody sequence
atggcttgggtgtggaccttgctattcctgatggcagctgcccaaagtatacaggccgaggtgcagctggtggaaagcggcggaggactggtcaagcctggcggcagcctgaagctgagctgcgccgccagcggcttcaccttcagcagctacgccatgagctgggtccgacagacccccgagaagcggctggaatgggtggccaccatcagcaccagcggcagctacacctactaccgggacagcgtgaagggccggctgaccatcagccgggacaacgccaagaacaccctgtacctgcagatgaccagcctgcggagcgaggacaccgccatgtactactgcacccggcacggcgaccacgacggcttcgattactggggccagggcaccaccctgaccgtgtcctctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatga

SEQ ID NO: 1199 - DNA, 1404 bp, Artificial
  antibody sequence
atggcttgggtgtggaccttgctattcctgatggcagctgcccaaagtatacaggccgaggtgcagctggtggaaagcggcggaggactggtcaagcctggcggcagcctgaagctgagctgcgtggcctccggcttcagcttcagcaactacgccatgagctgggtccgacagacccccgagcggagactggaatgggtggccaccatcaacagcggcggcagcttcagctttttcccagactccgtgaagggccggttcaccatcagccgggacagcgccaagaacaccctgtacctgcagatgagcagcctgcggagcgacgacaccgccatgtactactgcacccggcactgggaccacccttggtttgcctactggggccagggcaccctggtcaccgtgtctgctgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatga

SEQ ID NO: 1200 - DNA, 1404 bp, Artificial; identical to SEQ ID NO: 1199
  antibody sequence

SEQ ID NO: 1201 - DNA, 1404 bp, Artificial; identical to SEQ ID NO: 1199
  antibody sequence

SEQ ID NO: 1202 - DNA, 1392 bp, Artificial
  antibody sequence
atggcttgggtgtggaccttgctattcctgatggcagctgcccaaagtatacaggccgaggtgcagctgcagcagtctggcgctgaactcgtgcggcctggcgccagcgtgaagctgagctgcaccaccagcggcttcaacatcaaggacagcctgatctactgggtcaagcagcggcccgagcagggcctggaatggatcggctggatcgaccccgaggacggcgagacaaagttcgcccccagattccaggacaaggccaccatcaccagcgacaccagcagcaacaccgcctacctgcggctgagcagcctgaccagcaaggacaccgccatctactactgcacccggtccttcggcgtgtgctggggccagggcaccctggtcacagtgtctgccgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatga

SEQ ID NO: 1203 - DNA, 1392 bp, Artificial
  antibody sequence
atggcttgggtgtggaccttgctattcctgatggcagctgcccaaagtatacaggccgaggtgcagctgcagcagtctggcgctgaactcgtgcggcctggcgccagcgtgaagctgagctgcaccaccagcggcttcaacatcaaggacagcctgatctactgggtcaagcagcggcccgagcagggcctggaatggatcggctggatcgaccccgaggacggcgagacaaagttcgcccccagattccaggacaaggccaccatcaccagcgacaccagcagcaacaccgcctacctgcggctgagcagcctgaccagcgaggacaccgccatctactactgcacccggtccttcggcgtgtgctggggccagggcaccctggtcacagtgtctgccgccaaaacaacagcaccaagtgtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatga

SEQ ID NO: 1204 - DNA, 642 bp, Artificial
  antibody sequence
gacatccagatgacccagagccctagcagcctgagcgcctctctgggcgagagagtgtccctgacctgcagagccagccaggacatcggcagctccctgaactggctgcagcaggaacccgacggcaccatcaagcggctgatctacgccaccagcagcctggatagcggcgtgcccaagagattcagcggcagcagaagcggcagcgactacagcctgaccatctccagcctggaatccgaggacttcgtggactactactgcctgcagtacgccagcagcccctggacctttggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 1205 - DNA, 642 bp, Artificial
  antibody sequence
gacatccagatgacccagaccaccagcagcctgagcgccagcctgggcgacagagtgaccatcagctgctgggccagccaggacatcagaagctacctgaactggtatcagcagaaacccgacggcaccgtgaagctgctgatctactacaccagccggctgcacagcggcgtgcccagcagattttctggcagcggcagcggcaccgacttcagcctgaccatctccaacctggaacaggaagatatcgctacctacttctgtcagcagggcaacaccctgccctacaccttcggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 1206 - DNA, 642 bp, Artificial
  antibody sequence
gacatccagatgacccagagccccagcagcctgagcgccagcctgggcgagagagtgtccctgacctgccgggccagccaggaaatcagcggctacctgagctggctgcagcagaagcccgacggcaccatcaagcggctgatctacgccgccagcaccctggacagcggcgtgcccaagagattcagcggcagccgcagcggcagcgactacagcctgaccatcagcagcctggaaagcgaggacttcgccgactactactgcctgcagtacgccagctacccccggaccttcggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 1207 - DNA, 657 bp, Artificial
  antibody sequence
gacgtgctgatgacccagacccccctgagcctgcccgtgtctctgggcgatcaggccagcatcagctgccggtccagccagatcatcgtgcacagcaacggcaacacctacctggactggtatctgcagaagcccggccagagccccaagctgctgatctacaagatcagcaaccggttcagcggcgtgcccgacagattcagcggcagcggctccggcaccgacttcaccctgaagatcagccgggtggaagccgaggacctgggcgtgtactactgttttcagggcagccacgtgccctggaccttcggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 1208 - DNA, 657 bp, Artificial
  antibody sequence
gacgtggtggtcacccagacccccctgagcctgcccgtgtccttcggcgaccaggtgtccatcagctgcagaagcagccagagcctggccaacagctacggcaacacctacctgagctggtatctgcacaagcccggccagagcccccagctgctgatctacggcatcagcaaccggttcagcggcgtgcccgacagattcagcggcagcggctccggcaccgacttcaccctgaagatcagcaccatcaagcccgagggcctgggcatgtactactgtctgcagggcacccaccagccccccacctttggcgctggcaccaagctggaactgaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 1209 - DNA, 657 bp, Artificial
  antibody sequence
gacatcgtgctgacccagagccctgccagcctggccgtgtctctgggccagagagccaccatcagctgccgggccagcgagagcgtggacagctacggcaacagcttcatgcactggtatcagcagaagcccggccagccccccaagctgctgatctaccgggccagcaacctggaaagcggcatccccgccagattcagcggcagcggcagccggaccgacttcaccctgaccatcaaccccgtggaagccgacgacgtggccacctactactgccagcagagcaacgaggaccccccctggaccttcggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 1210 - DNA, 657 bp, Artificial
  antibody sequence
gacatcgtgatgagccagagccccagcagcctggccgtgtctgccggcgagaaagtgaccatgagctgcaagagcagccagagcctgctgaacagccggacccggaagaactacctggcctggtatcagcagaagcccggccagtcccccaagctgctgatctactgggccagcacccgcgagagcggcgtgcccgatagattcacaggcagcggcagcggcaccgacttcaccctgaccatcagcagcgtgcaggccgaggatctggccgtgtactactgcaagcagagctacaacctgtggaccttcggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 1211 - DNA, 657 bp, Artificial
  antibody sequence
gacgtggtcatgacccagacccccctgagcctgcccgtgtctctgggcgatcaggccagcatcagctgcagaagcagccagagcctgctgcacagcaacggcaagacctacctgcactggtatctgcagaagcccggccagagccccaagctgctgatctacaaggtgtccaaccggttcagcggcgtgcccgacagattcagcggcagcggctccggcaccgacttcaccctgaagatcagccgggtggaagccgaggacctgggcgtgtacttctgcagccagtccacccacgtgcccctgaccttcggagccggcaccaagctggaactgaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 1212 - DNA, 642 bp, Artificial
  antibody sequence
gacatcgtgatgacccagagccacaagttcatgagcaccagcgtgggcgaccgggtgtccatcacatgcaaggccagccaggatgtgtctgccgccgtggcctggtatcagcagaagcccggccagagccccaagctgctgatctactgggccagcaccagacacaccggcgtgcccgacagattcacaggcagcggcagcggcaccgactacaccctgaccatcagcagcgtgcaggccgaggacctggccctgtactactgccagcagcactacagcacccccggcaccttcggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 1213 - DNA, 657 bp, Artificial
  antibody sequence
gacgtgctgatgacccagacccccctgagcctgcccgtgtctctgggcgatcaggccagcatcagctgccggtccagccagaccatcgtgcacagcagcggcaacacctacctggaatggtatctgcagcggcctggccagagccccaagctgctgatctacaaggtgtccaaccggttcagcggcgtgcccgacagattcagcggcagcggctccggcaccgacttcaccctgaagatcagccgggtggaagccgaggacctgggcgtgtactactgttttcagggcagccacgtgccctacaccttcggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 1214 - DNA, 642 bp, Artificial
  antibody sequence
gacatccagatgacccagaccaccagcagcctgagcgccagcctgggcgacagagtgaccatcagctgtagcgcctcccagggcatcagcaactacctgaactggtatcagcagaaacccgacggcaccgtgaagctgctgatctactacaccagctccctgcacagcggcgtgcccagcagattttctggcagcggcagcggcaccgactacagcctgaccatctccaacctggaacccgaggatatcgccacctactactgccagcagtacagcaagctgcccttcaccttcggctccggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 1215 - DNA, 660 bp, Artificial
  antibody sequence
gacatcgtgatgagccagagccccagcagcctggccgtgtccgtgggcgagaaagtgaccatgagctgcaagagcagccagagcctgctgtacagctccaaccagaagaactacctggcctggtatcagcagaagcccggccagtcccccaagctgctgatctactgggccagcacccgcgagagcggcgtgccagatagactgacaggcagcggcagcggcaccgacttcaccctgaccatcagcagcgtgaaggccgaggatctggccgtgtactactgccagcagtactacagctacccctacaccttcggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 1216 - DNA, 642 bp, Artificial
  antibody sequence
gacattcagatgactcagtctccagcctccctatctgtatctgtgggagaaactgtcaccatcacatgtcgagcaagtgaaaatatttacagtaatttagcatggtatcagcagaaacagggaaaatctcctcagctcctggtctatgctgcaacaaacttagcagatggtgtgccatcaaggttcagtggcagtggatcaggcacacagtattccctcaagatcaacagcctgcagtctgaagattttgggagttattactgtcaacatttttggggtactccgtacacgttcggaggggggaccaagctggaaataaaacgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 1217 - DNA, 642 bp, Artificial
  antibody sequence
gacatcaagatgacccagagccccagctctatgtacgccagcctgggcgagcgcgtgaccatcacatgcaaggccagccaggacatcaacagctacctgagctggttccagcagaagcccggcaagagccccaagaccctgatctaccgggccaacagactggtggacggcgtgccaagcagattcagcggcagcggctctggccaggactacagcctgaccatcagcagcctggaatacgaggacatgggcatctactactgcctgcagtacgacgagttcccctacaccttcggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 1218 - DNA, 642 bp, Artificial
  antibody sequence
gacatccagatgacccagaccaccagcagcctgagcgccagcctgggcgacagagtgaccatcagctgtagcgcctcccagggcatcagcaactacctgaactggtatcagcagaaacccgacggcaccgtgaagctgctgatccactacaccagctccctgcacagcggcgtgcccagcagattttctggcagcggcagcggcaccgactacagcctgaccatctccaacctggaacccgaggatatcgccacctactactgccagcagtacagcaagctgccctggaccttcggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 1219 - DNA, 657 bp, Artificial
  antibody sequence
gacgtgctgatgacccagacccccctgagcctgcccgtgtctctgggcgatcaggccagcatcagctgccggtccagccagaccatcgtgtacagcgacggcaacacctacctggaatggtatctgcagaagcccggccagagccccaagctgctgatctacaaggtgtccaaccggttcagcggcgtgcccgacagagtgtctggcagcggcagcggcaccgacttcaccctgaagatcagccgggtggaagccgaggacctgggcgtgtactactgttttcagggcagccacgtgccctacaccttcggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 1220 - DNA, 657 bp, Artificial; identical to SEQ ID NO: 1219
  antibody sequence

SEQ ID NO: 1221 - DNA, 657 bp, Artificial
  antibody sequence
gacatcgtgatgacccaggccgctcccagcgtgccagtgacacctggcgagagcgtgtccatcagctgcagaagcagcaagagcctgctgcacagcaacggcaatacctacctgtactggttcctgcagcggcctggccagagcccccagctgctgatctaccggatgagcaacctggccagcggcgtgcccgacagattttctggcagcggcagcggcaccgccttcaccctgcggatcagcagagtggaagccgaggacgtgggcgtgtactactgcatgcagcacctggaataccccttcaccttcggctccggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 1222 - DNA, 642 bp, Artificial
  antibody sequence
gatatccagatgacacagactacatcctccctgtctgcctctctgggagacagagtcaccatcagttgcagtgcaagtcagggcattagcaattatttaaactggtatcagcagaaaccagatggaactgttaaactcctgatctattacacatcaagtttacactcaggagtcccatcaaggttcagtggcagtgggtctgggacagattattctctcaccatcagcaacctggaacctgaagatattgccacttactattgtcagcagtatagtaagcttccgtacacgttcggaggggggaccaagctggaaataaaacgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 1223 - DNA, 642 bp, Artificial
  antibody sequence
gacatccagatgacccagagccccgccagcctgagcgcctctgtgggcgagacagtgaccatcatctgccgggccagcgagaacatctacagctacctggcctggtatcagcagaagcagggcaagagcccccagctgctggtgtacaacgccaagaccctggtggaaggcgtgcccagcagattcagcggcagcggctccggcacccagttcagcctgaagatcaacagcctgcagcccgaggacttcggcagctactactgccagcaccactacggcagcccctacaccttcggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 1224 - DNA, 642 bp, Artificial
  antibody sequence
gacattgtgatgacccagtctcacaaattcatgtccacatcagtaggagacagggtcagcatcacctgcaaggccagtcaggatgtgagtactgctgtagcctggtatcaacagaaaccaggacaatctcctaaactactgatttactcggcatcctaccggtacactggagtccctgatcgcttcactggcagtggatctgggacggatttcactttcaccatcagcagtgtgcaggctgaagacctggcagtttattactgtcagcaacattatagtactccgtggacgttcggtggaggcaccaagctggaaatcaaacgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 1225 - DNA, 642 bp, Artificial
  antibody sequence
gagacaaccgtgacccagagccccgccagcctgagcatggccatcggcgagaaagtgaccatccggtgcatcaccagcaccgacatcgacgacgacatgaactggtatcagcagaagcccggcgagccccccaagctgctgatcagcgagggcaacaccctgcggcctggcgtgcccagcagattcagcagcagcggctacggcaccgacttcgtgttcaccatcgagaacatgctgagcgaggacgtggccgactactactgcctgcagagcgacaacctgccctacaccttcggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 1226 - DNA, 660 bp, Artificial
  antibody sequence
gacatcgtgatgacccagagccccagcagcctgtccgtgtctgccggcgagaaagtgaccatgagctgcaagagcagccagagcctgctgaacagcggcaaccagaagaactacctggcctggtatcagcagaagcccggccagccccccaagctgctgatctacggcgccagcaccagagaaagcggcgtgcccgacagattcaccggcagcggctccggcaccgacttcaccctgaccatcagcagcgtgcaggccgaggacctggccgtgtactactgccagaacgaccacagctacccccccaccttcggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 1227 - DNA, 642 bp, Artificial
  antibody sequence
gacatccagatgacccagagccccagcagcctgagcgccagcctgggcgagagagtgtccctgacctgccgggccagccaggacatcggcaacagcctgaactggctgcagcagaagcccgacggcaccatcaagcggctgatctacgccaccagcaacctggacagcggcgtgcccaagcggttcagcggcagcagatccggcagcgactacagcctgaccatcagcagcctggaaagcgaggacttcgtgaactactactgcctgcagttcgccagcagccccctgaccttcggcaccggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 1228 - DNA, 642 bp, Artificial; identical to SEQ ID NO: 1216
  antibody sequence

SEQ ID NO: 1229 - DNA, 639 bp, Artificial
  antibody sequence
cagatcgtgctgacccagagccccgccatcatgagcgccagccctggcgagaaagtgaccatgacctgcagcgccagcagcaacgtgtcctacatgcactggttccagcagaagtccggcaccagccccaagcggtggatctacgacaccagcaagctggccagcggcgtgcccgccagattttctggcagcggcagcggcaccagctacagcctgaccgtgtccagcatggaagccgaggacgccgccacctactactgccagcagtggtccagcaacccccggaccttcggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 1230 - DNA, 642 bp, Artificial
  antibody sequence
gacatccagatgacccagagccccagcagcctgagcgccagcctgggcgagagagtgtccctgacctgccgggccagccaggacatcggcagctacctgaactggctgcagcaggaacccgacggcaccatcaagcggctgatctacgccaccagctccctggacagcggcgtgcccaagcggttcagcggcagcagatctggcgccgactacagcctgaccatcagcagcctggaaagcgaggacttcgtggactactactgcctgcagtacgccacctccccctggaccttcggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 1231 - DNA, 642 bp, Artificial
  antibody sequence
gacatccagatgacccagagcagcagctacctgagcgtgtccctgggcggcagagtgaccatcacatgcaaggccagcgaccacatcaacaactggctggcctggtatcagcagaagcccggcaacgcccccagactgctgatcagcggcgccaccagcctggaaaccggcgtgccaagcagattcagcggcagcggctccggcaaggactacaccctgagcatcaccagcctgcagaccgaggacgtggccacctactactgccagcagtactggtccaccccctacaccttcggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 1232 - DNA, 636 bp, Artificial
  antibody sequence
cagatcgtgctgacccagagccctgccctgatgagcgccagccctggcgagaaagtgaccatgacctgcagcgccagcagcagcgtgtcctacatgtactggtatcagcagaagcccagaagcagccccaagctgaagtacgccagcaacctggccagcggcgtgcccgccagattttctggcagcggcagcggcaccagctacagcctgaccatcagcagcatggaagccgaggacgccgccacctactactgccagcagtggtccagcaacccccccatcaccttcggagccggcaccaagctggaactgaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 1233 - DNA, 642 bp, Artificial; identical to SEQ ID NO: 1115
  antibody sequence

SEQ ID NO: 1234 - DNA, 645 bp, Artificial
  antibody sequence
cagatcgtgctgacccagagccccgccatcatgagcgccagccctggcgagaaagtgaccctgacctgcagcgccagcagcagcgtgtccagcagctacctgttctggtatcagcagaagcccggcagcagccccaagctgtggatctacagcaccagcaacctggccagcggcgtgcccgtgcggtttagcggcagcggctttggcaccagctacagcctgaccatcagccggatggaagccgaggacgccgccagctacttctgccaccagtggtccagctacccccccaccttcggagccggcaccaagctggaactgaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 1235 - DNA, 654 bp, Artificial
  antibody sequence
gacatcgtgctgacccagagccctgccagcctggccgtgtctctgggccagagagccaccatcagctgccgggccagcgagagcgtggacagctacggcaacagcttcatgcactggtatcagcagaagcccggccagccccccaagctgctgatctacctggccagcaacctggaaagcggcgtgcccgccagattcagcggcagcggcagcagaaccgacttcaccctgaccatcgaccccgtggaagccgacgacgccgccacctactactgccagcagaacaacgaggacccctacaccttcggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 1236 - DNA, 657 bp, Artificial
  antibody sequence
gacgtgctgatgacccagacccccctgagcctgcccgtgtctctgggcgatcaggccagcatcagctgccggtccagccagagcatcgtgtacagcaacggcaacacctacctggactggtatctgcagaagcccggccagccccccaagctgctgatctacaaggtgtccaaccggttcagcggcgtgcccgacagattcagcggcagcggctccggcaccgacttcatcctgaagatcagccgggtggaagccgaggacctgggcgtgtactactgttttcagggcagccacgtgccctggaccttcggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 1237 - DNA, 657 bp, Artificial
  antibody sequence
gacgtggtggtcacccagacccccctgagcctgcccgtgtccttcggcgaccaggtgtccatcagctgcagaagcagccagagcctggccaacagctacggcaacacctacctgagctggtatctgcacaagcccggccagagcccccagctgctgatctacggcatcagcaaccggttcagcggcgtgcccgacagattcagcggcagcggctccggcaccgacttcaccctgaagatcagcaccatcaagcccgaggacctgggcatgtactactgtctgcagggcacccaccagccctacaccttcggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 1238 - DNA, 657 bp, Artificial
  antibody sequence
gacatcgtgatgagccagagccccagcagcctggccgtgtccgtgggcgagaaagtgaccatgagctgcaagagcagccagagcgtgctgtacaacagcaaccagcggaactacctggcctggtatcagcagaagcccggccagtcccccaagctgctgatctactgggccagcacccgcgagagcggcgtgccagatagaagcacaggcagcggcagcggcaccgacttcaccctgaccatcagcagcgtgcaggccgaggatctggccgtgtactactgccaccagtacctgagcagctacaccttcggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 1239 - DNA, 642 bp, Artificial
  antibody sequence
gacatcgtgatgacccagagccacaagttcatgagcaccagcgtgggcgaccgggtgtccatcacatgcaaggccagccaggacgtgggcaccgccgtggcctggtatcagcagaagcccggccagagccccaagctgctgatctactgggccagcaccagacacaccggcgtgcccgacagattcacaggcagcggcagcggcaccgacttcaccctgaccatcagcaacgtgcagagcgaggacctggccgactacttctgccagcagtacagcagctaccccctgaccttcggagccggcaccaagctggaactgaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 1240 - DNA, 657 bp, Artificial; identical to SEQ ID NO: 1209
  antibody sequence

SEQ ID NO: 1241 - DNA, 657 bp, Artificial; identical to SEQ ID NO: 1209
  antibody sequence

SEQ ID NO: 1242 - DNA, 642 bp, Artificial
  antibody sequence
gacatccagatgacccagaccaccagcagcctgagcgccagcctgggcgacagagtgaccatcagctgccgggccagccaggacatcgacaactacctgaactggtatcagcagaaacccgacggcaccgtgaagctgctgatcagctacaccagccggctgcacagcggcgtgcccagcagattttctggcagcggcagcggcaccgactacagcctgaccatctccaacctggaacaggaagatttcgctacctacttctgtcagcagggctacaccctgccctggaccttcggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 1243 - DNA, 705 bp, Artificial
  antibody sequence
atggagacacattctcaggtctttgtatacatgttgctgtggttgtctggtgtcgagggcgacatccagatgacccagagccctagcagcctgagcgcctctctgggcgagagagtgtccctgacctgcagagccagccaggacatcggcagctccctgaactggctgcagcaggaacccgacggcaccatcaagcggctgatctacgccaccagcagcctggatagcggcgtgcccaagagattcagcggcagcagaagcggcagcgactacagcctgaccatctccagcctggaatccgaggacttcgtggactactactgcctgcagtacgccagcagcccctggacctttggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 1244 - DNA, 705 bp, Artificial
  antibody sequence
atggagacacattctcaggtctttgtatacatgttgctgtggttgtctggtgtcgagggcgacatccagatgacccagaccaccagcagcctgagcgccagcctgggcgacagagtgaccatcagctgctgggccagccaggacatcagaagctacctgaactggtatcagcagaaacccgacggcaccgtgaagctgctgatctactacaccagccggctgcacagcggcgtgcccagcagattttctggcagcggcagcggcaccgacttcagcctgaccatctccaacctggaacaggaagatatcgctacctacttctgtcagcagggcaacaccctgccctacaccttcggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 1245 - DNA, 705 bp, Artificial
  antibody sequence
atggagacacattctcaggtctttgtatacatgttgctgtggttgtctggtgtcgagggcgacatccagatgacccagagccccagcagcctgagcgccagcctgggcgagagagtgtccctgacctgccgggccagccaggaaatcagcggctacctgagctggctgcagcagaagcccgacggcaccatcaagcggctgatctacgccgccagcaccctggacagcggcgtgcccaagagattcagcggcagccgcagcggcagcgactacagcctgaccatcagcagcctggaaagcgaggacttcgccgactactactgcctgcagtacgccagctacccccggaccttcggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 1246 - DNA, 720 bp, Artificial
  antibody sequence
atggagacacattctcaggtctttgtatacatgttgctgtggttgtctggtgtcgagggcgacgtgctgatgacccagacccccctgagcctgcccgtgtctctgggcgatcaggccagcatcagctgccggtccagccagatcatcgtgcacagcaacggcaacacctacctggactggtatctgcagaagcccggccagagccccaagctgctgatctacaagatcagcaaccggttcagcggcgtgcccgacagattcagcggcagcggctccggcaccgacttcaccctgaagatcagccgggtggaagccgaggacctgggcgtgtactactgttttcagggcagccacgtgccctggaccttcggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 1247 - DNA, 720 bp, Artificial
  antibody sequence
atggagacacattctcaggtctttgtatacatgttgctgtggttgtctggtgtcgagggcgacgtggtggtcacccagacccccctgagcctgcccgtgtccttcggcgaccaggtgtccatcagctgcagaagcagccagagcctggccaacagctacggcaacacctacctgagctggtatctgcacaagcccggccagagcccccagctgctgatctacggcatcagcaaccggttcagcggcgtgcccgacagattcagcggcagcggctccggcaccgacttcaccctgaagatcagcaccatcaagcccgagggcctgggcatgtactactgtctgcagggcacccaccagccccccacctttggcgctggcaccaagctggaactgaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 1248 - DNA, 720 bp, Artificial
  antibody sequence
atggagacacattctcaggtctttgtatacatgttgctgtggttgtctggtgtcgagggcgacatcgtgctgacccagagccctgccagcctggccgtgtctctgggccagagagccaccatcagctgccgggccagcgagagcgtggacagctacggcaacagcttcatgcactggtatcagcagaagcccggccagccccccaagctgctgatctaccgggccagcaacctggaaagcggcatccccgccagattcagcggcagcggcagccggaccgacttcaccctgaccatcaaccccgtggaagccgacgacgtggccacctactactgccagcagagcaacgaggaccccccctggaccttcggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 1249 - DNA, 720 bp, Artificial
  antibody sequence
atggagacacattctcaggtctttgtatacatgttgctgtggttgtctggtgtcgagggcgacatcgtgatgagccagagccccagcagcctggccgtgtctgccggcgagaaagtgaccatgagctgcaagagcagccagagcctgctgaacagccggacccggaagaactacctggcctggtatcagcagaagcccggccagtcccccaagctgctgatctactgggccagcacccgcgagagcggcgtgcccgatagattcacaggcagcggcagcggcaccgacttcaccctgaccatcagcagcgtgcaggccgaggatctggccgtgtactactgcaagcagagctacaacctgtggaccttcggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 1250 - DNA, 720 bp, Artificial
  antibody sequence
atggagacacattctcaggtctttgtatacatgttgctgtggttgtctggtgtcgagggcgacgtggtcatgacccagacccccctgagcctgcccgtgtctctgggcgatcaggccagcatcagctgcagaagcagccagagcctgctgcacagcaacggcaagacctacctgcactggtatctgcagaagcccggccagagccccaagctgctgatctacaaggtgtccaaccggttcagcggcgtgcccgacagattcagcggcagcggctccggcaccgacttcaccctgaagatcagccgggtggaagccgaggacctgggcgtgtacttctgcagccagtccacccacgtgcccctgaccttcggagccggcaccaagctggaactgaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 1251 - DNA, 705 bp, Artificial
  antibody sequence
atggagacacattctcaggtctttgtatacatgttgctgtggttgtctggtgtcgagggcgacatcgtgatgacccagagccacaagttcatgagcaccagcgtgggcgaccgggtgtccatcacatgcaaggccagccaggatgtgtctgccgccgtggcctggtatcagcagaagcccggccagagccccaagctgctgatctactgggccagcaccagacacaccggcgtgcccgacagattcacaggcagcggcagcggcaccgactacaccctgaccatcagcagcgtgcaggccgaggacctggccctgtactactgccagcagcactacagcacccccggcaccttcggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 1252 - DNA, 720 bp, Artificial
  antibody sequence
atggagacacattctcaggtctttgtatacatgttgctgtggttgtctggtgtcgagggcgacgtgctgatgacccagacccccctgagcctgcccgtgtctctgggcgatcaggccagcatcagctgccggtccagccagaccatcgtgcacagcagcggcaacacctacctggaatggtatctgcagcggcctggccagagccccaagctgctgatctacaaggtgtccaaccggttcagcggcgtgcccgacagattcagcggcagcggctccggcaccgacttcaccctgaagatcagccgggtggaagccgaggacctgggcgtgtactactgttttcagggcagccacgtgccctacaccttcggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 1253 - DNA, 705 bp, Artificial
  antibody sequence
atggagacacattctcaggtctttgtatacatgttgctgtggttgtctggtgtcgagggcgacatccagatgacccagaccaccagcagcctgagcgccagcctgggcgacagagtgaccatcagctgtagcgcctcccagggcatcagcaactacctgaactggtatcagcagaaacccgacggcaccgtgaagctgctgatctactacaccagctccctgcacagcggcgtgcccagcagattttctggcagcggcagcggcaccgactacagcctgaccatctccaacctggaacccgaggatatcgccacctactactgccagcagtacagcaagctgcccttcaccttcggctccggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 1254 - DNA, 723 bp, Artificial
  antibody sequence
atggagacacattctcaggtctttgtatacatgttgctgtggttgtctggtgtcgagggcgacatcgtgatgagccagagccccagcagcctggccgtgtccgtgggcgagaaagtgaccatgagctgcaagagcagccagagcctgctgtacagctccaaccagaagaactacctggcctggtatcagcagaagcccggccagtcccccaagctgctgatctactgggccagcacccgcgagagcggcgtgccagatagactgacaggcagcggcagcggcaccgacttcaccctgaccatcagcagcgtgaaggccgaggatctggccgtgtactactgccagcagtactacagctacccctacaccttcggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 1255 - DNA, 705 bp, Artificial
  antibody sequence
atggagacacattctcaggtctttgtatacatgttgctgtggttgtctggtgtcgagggcgacattcagatgactcagtctccagcctccctatctgtatctgtgggagaaactgtcaccatcacatgtcgagcaagtgaaaatatttacagtaatttagcatggtatcagcagaaacagggaaaatctcctcagctcctggtctatgctgcaacaaacttagcagatggtgtgccatcaaggttcagtggcagtggatcaggcacacagtattccctcaagatcaacagcctgcagtctgaagattttgggagttattactgtcaacatttttggggtactccgtacacgttcggaggggggaccaagctggaaataaaacgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 1256 - DNA, 705 bp, Artificial
  antibody sequence
atggagacacattctcaggtctttgtatacatgttgctgtggttgtctggtgtcgagggcgacatcaagatgacccagagccccagctctatgtacgccagcctgggcgagcgcgtgaccatcacatgcaaggccagccaggacatcaacagctacctgagctggttccagcagaagcccggcaagagccccaagaccctgatctaccgggccaacagactggtggacggcgtgccaagcagattcagcggcagcggctctggccaggactacagcctgaccatcagcagcctggaatacgaggacatgggcatctactactgcctgcagtacgacgagttcccctacaccttcggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 1257 - DNA, 705 bp, Artificial
  antibody sequence
atggagacacattctcaggtctttgtatacatgttgctgtggttgtctggtgtcgagggcgacatccagatgacccagaccaccagcagcctgagcgccagcctgggcgacagagtgaccatcagctgtagcgcctcccagggcatcagcaactacctgaactggtatcagcagaaacccgacggcaccgtgaagctgctgatccactacaccagctccctgcacagcggcgtgcccagcagattttctggcagcggcagcggcaccgactacagcctgaccatctccaacctggaacccgaggatatcgccacctactactgccagcagtacagcaagctgccctggaccttcggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 1258 - DNA, 720 bp, Artificial
  antibody sequence
atggagacacattctcaggtctttgtatacatgttgctgtggttgtctggtgtcgagggcgacgtgctgatgacccagacccccctgagcctgcccgtgtctctgggcgatcaggccagcatcagctgccggtccagccagaccatcgtgtacagcgacggcaacacctacctggaatggtatctgcagaagcccggccagagccccaagctgctgatctacaaggtgtccaaccggttcagcggcgtgcccgacagagtgtctggcagcggcagcggcaccgacttcaccctgaagatcagccgggtggaagccgaggacctgggcgtgtactactgttttcagggcagccacgtgccctacaccttcggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 1259 - DNA, 720 bp, Artificial; identical to SEQ ID NO: 1258
  antibody sequence

SEQ ID NO: 1260 - DNA, 720 bp, Artificial
  antibody sequence
atggagacacattctcaggtctttgtatacatgttgctgtggttgtctggtgtcgagggcgacatcgtgatgacccaggccgctcccagcgtgccagtgacacctggcgagagcgtgtccatcagctgcagaagcagcaagagcctgctgcacagcaacggcaatacctacctgtactggttcctgcagcggcctggccagagcccccagctgctgatctaccggatgagcaacctggccagcggcgtgcccgacagattttctggcagcggcagcggcaccgccttcaccctgcggatcagcagagtggaagccgaggacgtgggcgtgtactactgcatgcagcacctggaataccccttcaccttcggctccggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 1261 - DNA, 705 bp, Artificial
  antibody sequence
atggagacacattctcaggtctttgtatacatgttgctgtggttgtctggtgtcgagggcgatatccagatgacacagactacatcctccctgtctgcctctctgggagacagagtcaccatcagttgcagtgcaagtcagggcattagcaattatttaaactggtatcagcagaaaccagatggaactgttaaactcctgatctattacacatcaagtttacactcaggagtcccatcaaggttcagtggcagtgggtctgggacagattattctctcaccatcagcaacctggaacctgaagatattgccacttactattgtcagcagtatagtaagcttccgtacacgttcggaggggggaccaagctggaaataaaacgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 1262 - DNA, 705 bp, Artificial
  antibody sequence
atggagacacattctcaggtctttgtatacatgttgctgtggttgtctggtgtcgagggcgacatccagatgacccagagccccgccagcctgagcgcctctgtgggcgagacagtgaccatcatctgccgggccagcgagaacatctacagctacctggcctggtatcagcagaagcagggcaagagcccccagctgctggtgtacaacgccaagaccctggtggaaggcgtgcccagcagattcagcggcagcggctccggcacccagttcagcctgaagatcaacagcctgcagcccgaggacttcggcagctactactgccagcaccactacggcagcccctacaccttcggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 1263 - DNA, 705 bp, Artificial
  antibody sequence
atggagacacattctcaggtctttgtatacatgttgctgtggttgtctggtgtcgagggcgacattgtgatgacccagtctcacaaattcatgtccacatcagtaggagacagggtcagcatcacctgcaaggccagtcaggatgtgagtactgctgtagcctggtatcaacagaaaccaggacaatctcctaaactactgatttactcggcatcctaccggtacactggagtccctgatcgcttcactggcagtggatctgggacggatttcactttcaccatcagcagtgtgcaggctgaagacctggcagtttattactgtcagcaacattatagtactccgtggacgttcggtggaggcaccaagctggaaatcaaacgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 1264 - DNA, 705 bp, Artificial
  antibody sequence
atggagacacattctcaggtctttgtatacatgttgctgtggttgtctggtgtcgagggcgagacaaccgtgacccagagccccgccagcctgagcatggccatcggcgagaaagtgaccatccggtgcatcaccagcaccgacatcgacgacgacatgaactggtatcagcagaagcccggcgagccccccaagctgctgatcagcgagggcaacaccctgcggcctggcgtgcccagcagattcagcagcagcggctacggcaccgacttcgtgttcaccatcgagaacatgctgagcgaggacgtggccgactactactgcctgcagagcgacaacctgccctacaccttcggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 1265 - DNA, 723 bp, Artificial
  antibody sequence
atggagacacattctcaggtctttgtatacatgttgctgtggttgtctggtgtcgagggcgacatcgtgatgacccagagccccagcagcctgtccgtgtctgccggcgagaaagtgaccatgagctgcaagagcagccagagcctgctgaacagcggcaaccagaagaactacctggcctggtatcagcagaagcccggccagccccccaagctgctgatctacggcgccagcaccagagaaagcggcgtgcccgacagattcaccggcagcggctccggcaccgacttcaccctgaccatcagcagcgtgcaggccgaggacctggccgtgtactactgccagaacgaccacagctacccccccaccttcggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 1266 - DNA, 705 bp, Artificial
  antibody sequence
atggagacacattctcaggtctttgtatacatgttgctgtggttgtctggtgtcgagggcgacatccagatgacccagagccccagcagcctgagcgccagcctgggcgagagagtgtccctgacctgccgggccagccaggacatcggcaacagcctgaactggctgcagcagaagcccgacggcaccatcaagcggctgatctacgccaccagcaacctggacagcggcgtgcccaagcggttcagcggcagcagatccggcagcgactacagcctgaccatcagcagcctggaaagcgaggacttcgtgaactactactgcctgcagttcgccagcagccccctgaccttcggcaccggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 1267 - DNA, 705 bp, Artificial; identical to SEQ ID NO: 1255
  antibody sequence

SEQ ID NO: 1268 - DNA, 702 bp, Artificial
  antibody sequence
atggagacacattctcaggtctttgtatacatgttgctgtggttgtctggtgtcgagggccagatcgtgctgacccagagccccgccatcatgagcgccagccctggcgagaaagtgaccatgacctgcagcgccagcagcaacgtgtcctacatgcactggttccagcagaagtccggcaccagccccaagcggtggatctacgacaccagcaagctggccagcggcgtgcccgccagattttctggcagcggcagcggcaccagctacagcctgaccgtgtccagcatggaagccgaggacgccgccacctactactgccagcagtggtccagcaacccccggaccttcggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 1269 - DNA, 705 bp, Artificial
  antibody sequence
atggagacacattctcaggtctttgtatacatgttgctgtggttgtctggtgtcgagggcgacatccagatgacccagagccccagcagcctgagcgccagcctgggcgagagagtgtccctgacctgccgggccagccaggacatcggcagctacctgaactggctgcagcaggaacccgacggcaccatcaagcggctgatctacgccaccagctccctggacagcggcgtgcccaagcggttcagcggcagcagatctggcgccgactacagcctgaccatcagcagcctggaaagcgaggacttcgtggactactactgcctgcagtacgccacctccccctggaccttcggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 1270 - DNA, 705 bp, Artificial
  antibody sequence
atggagacacattctcaggtctttgtatacatgttgctgtggttgtctggtgtcgagggcgacatccagatgacccagagcagcagctacctgagcgtgtccctgggcggcagagtgaccatcacatgcaaggccagcgaccacatcaacaactggctggcctggtatcagcagaagcccggcaacgcccccagactgctgatcagcggcgccaccagcctggaaaccggcgtgccaagcagattcagcggcagcggctccggcaaggactacaccctgagcatcaccagcctgcagaccgaggacgtggccacctactactgccagcagtactggtccaccccctacaccttcggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 1271 - DNA, 699 bp, Artificial
  antibody sequence
atggagacacattctcaggtctttgtatacatgttgctgtggttgtctggtgtcgagggccagatcgtgctgacccagagccctgccctgatgagcgccagccctggcgagaaagtgaccatgacctgcagcgccagcagcagcgtgtcctacatgtactggtatcagcagaagcccagaagcagccccaagctgaagtacgccagcaacctggccagcggcgtgcccgccagattttctggcagcggcagcggcaccagctacagcctgaccatcagcagcatggaagccgaggacgccgccacctactactgccagcagtggtccagcaacccccccatcaccttcggagccggcaccaagctggaactgaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 1272 - DNA, 705 bp, Artificial; identical to SEQ ID NO: 1121
  antibody sequence

SEQ ID NO: 1273 - DNA, 708 bp, Artificial
  antibody sequence
atggagacacattctcaggtctttgtatacatgttgctgtggttgtctggtgtcgagggccagatcgtgctgacccagagccccgccatcatgagcgccagccctggcgagaaagtgaccctgacctgcagcgccagcagcagcgtgtccagcagctacctgttctggtatcagcagaagcccggcagcagccccaagctgtggatctacagcaccagcaacctggccagcggcgtgcccgtgcggtttagcggcagcggctttggcaccagctacagcctgaccatcagccggatggaagccgaggacgccgccagctacttctgccaccagtggtccagctacccccccaccttcggagccggcaccaagctggaactgaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 1274 - DNA, 717 bp, Artificial
  antibody sequence
atggagacacattctcaggtctttgtatacatgttgctgtggttgtctggtgtcgagggcgacatcgtgctgacccagagccctgccagcctggccgtgtctctgggccagagagccaccatcagctgccgggccagcgagagcgtggacagctacggcaacagcttcatgcactggtatcagcagaagcccggccagccccccaagctgctgatctacctggccagcaacctggaaagcggcgtgcccgccagattcagcggcagcggcagcagaaccgacttcaccctgaccatcgaccccgtggaagccgacgacgccgccacctactactgccagcagaacaacgaggacccctacaccttcggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 1275 - DNA, 720 bp, Artificial
  antibody sequence
atggagacacattctcaggtctttgtatacatgttgctgtggttgtctggtgtcgagggcgacgtgctgatgacccagacccccctgagcctgcccgtgtctctgggcgatcaggccagcatcagctgccggtccagccagagcatcgtgtacagcaacggcaacacctacctggactggtatctgcagaagcccggccagccccccaagctgctgatctacaaggtgtccaaccggttcagcggcgtgcccgacagattcagcggcagcggctccggcaccgacttcatcctgaagatcagccgggtggaagccgaggacctgggcgtgtactactgttttcagggcagccacgtgccctggaccttcggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 1276 - DNA, 720 bp, Artificial
  antibody sequence
atggagacacattctcaggtctttgtatacatgttgctgtggttgtctggtgtcgagggcgacgtggtggtcacccagacccccctgagcctgcccgtgtccttcggcgaccaggtgtccatcagctgcagaagcagccagagcctggccaacagctacggcaacacctacctgagctggtatctgcacaagcccggccagagcccccagctgctgatctacggcatcagcaaccggttcagcggcgtgcccgacagattcagcggcagcggctccggcaccgacttcaccctgaagatcagcaccatcaagcccgaggacctgggcatgtactactgtctgcagggcacccaccagccctacaccttcggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 1277 - DNA, 720 bp, Artificial
  antibody sequence
atggagacacattctcaggtctttgtatacatgttgctgtggttgtctggtgtcgagggcgacatcgtgatgagccagagccccagcagcctggccgtgtccgtgggcgagaaagtgaccatgagctgcaagagcagccagagcgtgctgtacaacagcaaccagcggaactacctggcctggtatcagcagaagcccggccagtcccccaagctgctgatctactgggccagcacccgcgagagcggcgtgccagatagaagcacaggcagcggcagcggcaccgacttcaccctgaccatcagcagcgtgcaggccgaggatctggccgtgtactactgccaccagtacctgagcagctacaccttcggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 1278 - DNA, 705 bp, Artificial
  antibody sequence
atggagacacattctcaggtctttgtatacatgttgctgtggttgtctggtgtcgagggcgacatcgtgatgacccagagccacaagttcatgagcaccagcgtgggcgaccgggtgtccatcacatgcaaggccagccaggacgtgggcaccgccgtggcctggtatcagcagaagcccggccagagccccaagctgctgatctactgggccagcaccagacacaccggcgtgcccgacagattcacaggcagcggcagcggcaccgacttcaccctgaccatcagcaacgtgcagagcgaggacctggccgactacttctgccagcagtacagcagctaccccctgaccttcggagccggcaccaagctggaactgaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 1279 - DNA, 720 bp, Artificial; identical to SEQ ID NO: 1248
  antibody sequence

SEQ ID NO: 1280 - DNA, 720 bp, Artificial; identical to SEQ ID NO: 1248
  antibody sequence

SEQ ID NO: 1281 - DNA, 705 bp, Artificial
  antibody sequence
atggagacacattctcaggtctttgtatacatgttgctgtggttgtctggtgtcgagggcgacatccagatgacccagaccaccagcagcctgagcgccagcctgggcgacagagtgaccatcagctgccgggccagccaggacatcgacaactacctgaactggtatcagcagaaacccgacggcaccgtgaagctgctgatcagctacaccagccggctgcacagcggcgtgcccagcagattttctggcagcggcagcggcaccgactacagcctgaccatctccaacctggaacaggaagatttcgctacctacttctgtcagcagggctacaccctgccctggaccttcggcggaggcaccaagctggaaatcaagcgggctgatgctgcaccgactgtgtccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 1282 - protein, 233 aa, Artificial
  antibody sequence
EVQLQQSGAELVKPGASVKISCKASGYAFSSSWMNWLKQRPGKGLEWIGRIYPGDGDTNYNGKFKGKATLTADKSSSTAYMQLSSLTSEDSAVYFCARYGYDYDGEYYYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCHHHHHH

SEQ ID NO: 1283 - protein, 231 aa, Artificial
  antibody sequence
QVQLQQSGAELAKPGASVKMSCKSSGYTFSTYWMHWVKQRPGQGLEWIGYINPNTGYTEYNQKFKDTATLTADKSSSTAYMQLSSLTSEDSAVYYCARGGSKAFPYYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCHHHHHH

SEQ ID NO: 1284 - protein, 228 aa, Artificial
  antibody sequence
QVQLQQPGAELVKPGASVKLSCKASGYTFTRYWMHWVKQRPGQGLEWIGEINPNNGHTNYNEKFESRATLTVDKSSSTAYMQFNSLTSEDSAVYYCGRLDGHLYAVDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCHHHHHH

SEQ ID NO: 1285 - protein, 227 aa, Artificial
  antibody sequence
DVKLVESGGGLVKLGGSLKLSCAASGFTFSSYYMSWVRQTPEKRLELVAAINSNGGSTYYPDTVKGRFTISRDNAKNTLYLQMSSLKSEDTALYYCARPDYPYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCHHHHHH

SEQ ID NO: 1286 - protein, 223 aa, Artificial
  antibody sequence
EVQLQQSGAELVKPGASVKLSCTASGFNIKDTYMHWVRQRPEQGLEWIGRIDPANDITKYDPKFQGKATITADTSSNTAYLQLSSLTSEDTAVYYCGRDWADYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCHHHHHH

SEQ ID NO: 1287 - protein, 223 aa, Artificial
  antibody sequence
EVQLQQSGAELVKPGASVKLSCTASGFNIKDTYMHWVKQRSEQGLEWIGRINPANDNTKYDPKFQGKATITADTSSNTAYLQLSSLTSEDTAVYYCGRDWADYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCHHHHHH

SEQ ID NO: 1288 - protein, 225 aa, Artificial
  antibody sequence
QVQLQQSGAELMKPGASVKISCKASGYTFSDYWIEWIKQRPGHGLEWMGEILPGSDKTNYNEKFKGKATFTADSSSNTAYMQLNSLTSEDSAVFYCATAGDDYVKWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCHHHHHH

SEQ ID NO: 1289 - protein, 228 aa, Artificial
  antibody sequence
QVQLQQPGTELKMPGTSVKLSCKASGYTFTTYWMHWVKLRPGQGFEWIGEINPSNDGTNYNEKFKRKATLTVDKPSSTAYMQLSSLTSEDSTIYYCTISYYGYGDFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCHHHHHH

SEQ ID NO: 1290 - protein, 215 aa, Artificial
  antibody sequence
DIVMTQSPTTMAASPGERITITCSAHSNLISNYLHWYQQKPGFSPKLLIYRTSNLASGVPARFSGSGSGTSYSLTIGTMEAEDVATYFCQQGSSIPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1291 - protein, 218 aa, Artificial
  antibody sequence
DIVLTQSPASLAVSLGQRATMSCRASESVDGYGNSFLHWYQQKPGQPPKLLIYRASNLESGIPARFSGTGSRTDFTLTITPVEADDVATYYCQQSNGDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1292 - protein, 219 aa, Artificial
  antibody sequence
DVVMTQTPLTLSVTIGQPASISCKSSQSLLDSDGETYLNWLLQRPGQSPKRLIYMVSKLDSGVPDRFTGSGSGTDFTLKISRVEAEDLGVYYCWQGTHFPQTFGGGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1293 - protein, 213 aa, Artificial
  antibody sequence
QIVLTQSPAIMSASPGEKVTMTCSASSSVSYMHWYQQKSGTSPKRWIYDTSKLASGVPARFSGSGSGTSYSLTISSMEAEDAATYYCQQWISNPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1294 - protein, 219 aa, Artificial
  antibody sequence
DVVMTQTPLTLSVTIGQAASISCKSSQSLLHSDGKTYLNWLLQRPGQSPKRLIYLVSKLDSGVPDRFTGSGSGTDFTLKISRVEAEDLGVYYCWQGTHFPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1295 - protein, 219 aa, Artificial
  antibody sequence
DVVMTQTPLTLSVTVGQPASISCKSSQSLLHSDGKTYLNWLLQRPGQSPKRLIYLVSKLDSGVPDRFTGSGSGTDFTLKISRVEAEDLGVYYCWQGTHFPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1296 - protein, 219 aa, Artificial
  antibody sequence
DVLMTQTPLSLPVSLGDQASISCRSSQSIVYSNGNTYLEWYLQKPGQSPKLLIYKVSNRFSGVPDRFSGSGSGTDFTLKISRVEAEDLGVYYCFQGSHVPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1297 - protein, 219 aa, Artificial
  antibody sequence
DVVMTQTPLTLSVTNGQPASISCKSSQSLLDSDGETYLNWLLQRPGQSPKRLIYLVSKLDSGVPDRFIGSGSGTDFTLKISRVEAEDLGVYFCWQGTHSPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1298 - protein, 224 aa, Artificial
  antibody sequence
EVQLQQSGAELVKPGASVKMSCKASGYTFTDYYMDWVKQSHGKSFEWIGHVNPYNGDTRYNQKFKGKATLTVDKSSTTAYMELNSLTSEDSAVYYCARGNFFDYWGQGTTLSVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCHHHHHH

SEQ ID NO: 1299 - protein, 226 aa, Artificial
  antibody sequence
EVQLQQSGAELVKPGASVKISCKTSGYSFTGYFMNWVMQSHGKSLEWIGRINPYNGDTFYNQKFKGKATLTVDKSSSTAHMELRSLASEDSAVYYCARSYGYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCHHHHHH

SEQ ID NO: 1300 - protein, 226 aa, Artificial
  antibody sequence
EVKLVESGPELVKPGASVKISCKTSGYSFTGYFMNWVMQSHGKSLEWIGRINPYNGDTFYNQKFKGKATLTVDKSSSTAHMELRSLASEDSAVYYCARSYGYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCHHHHHH

SEQ ID NO: 1301 - protein, 213 aa, Artificial
  antibody sequence
DIVMTQSPAIMSASPGEKVTIPCSASSSVSYMHWFQQKPGTSPKLWIYSTSNLASGVPGRFSGSGSGTSYSLTISRMEAEDAATYYCQQRSNYPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1302 - protein, 219 aa, Artificial
  antibody sequence
DVVMTQTPLSLPVSLGDQASISCRSSQTIVHSNGNTYLEWYLQKPGQSPKLLIYKVSNRFSGVPDRFSGSGSGTDFTLKISRVEAEDLGVYYCFQGSHVPFTFGGGTKLEIRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1303 - protein, 219 aa, Artificial
  antibody sequence
DIKMTQSPLSLPVSLGDQASISCRSSQTIVHSNGNTYLEWYLQKPGQSPKLLIYKVSNRFSGVPDRFSGSGSGTDFTLKISRVEAEDLGVYYCFQGSHVPFTFGGGTKLEIRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1304 - protein, 229 aa, Artificial
  antibody sequence
EVQLQQSGGGLVKPGGSLKLSCAASGFTFSSYAMSWVRQTPEKRLEWVATITGGGTYTYYLDSVKGRFTISRDNAKTSLYLQMSSLRSEDTAMYYCARHRDGNYGCFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCHHHHHH

SEQ ID NO: 1305 - protein, 226 aa, Artificial
  antibody sequence
QVQLQQSGAELVMPGASVKMSCKASGYTFTDYWMHWVKQRPGQGLEWIGAIDTSDSYTSYNQKFKGKATLTVDESSSTAYMQLSSLTSEDSAVYYCARDYGYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCHHHHHH

SEQ ID NO: 1306 - protein, 215 aa, Artificial
  antibody sequence
DIVLTQSPAIMSASLGERVTMTCTASSSVSSSYLHWYQQKPGSSPKLWVYSTSNLASGVPARFSGSGSGSSYSLTISSMEPEDTATYYCHQYHRSPQTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1307 - protein, 213 aa, Artificial
  antibody sequence
QIVLTQSPAIMSASPGEKVTITCSASLSVSYMHWFQQKPGTSPKLWIYSASNLASGVPARFSGSGSGTSYSLTISRMEAEDAATYYCQQRSSYPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1308 - protein, 227 aa, Artificial
  antibody sequence
EVQLQQSGPELVKPGDSVKMSCKASGYTFTDYYIDWMKQSHGKSLEWIGYIYPNNGGTSYNQNFKDKATLTVDKSSSTAYMELHSLTSEDSAVYYCARLTYYAKVDSWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCHHHHHH

SEQ ID NO: 1309 - protein, 229 aa, Artificial
  antibody sequence
QVQLQQSGAELMNPGASVKISCKSTGYKFSSYWIEWVKQRPGHGLEWMGEILPGSGSTNHNEKFKGKAIFTADASSNTAYMELSSLTSEDSAVYYCARTISTATDWFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCHHHHHH

SEQ ID NO: 1310 - protein, 221 aa, Artificial
  antibody sequence
QVQLQQSGAELVRPGTSVKMSCKAAGYTFTNYWIGWVKQRPGHGLEWIGDIYPGGGYTNYNEKFKDKTTLTADTSSNTAYMQLSSLTSEDSAIYYCASNDCWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCHHHHHH

SEQ ID NO: 1311 - protein, 228 aa, Artificial
  antibody sequence
QVQLKESGPGLVAPSQSLSITCTVSGLSLTSYGLSWVRQPPGKGLEWLGVIWGDGSTNYHSALISRLSISKDNSKSQVFLKLNSLQSDDTATYYCATRGDYGSYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCHHHHHH

SEQ ID NO: 1312 - protein, 219 aa, Artificial
  antibody sequence
DVVMTQTPLSLPVSLGDQASISCRSSQSLLHSNGKTYLHWYLQKPGQSPKLLIYKVSNRFSGVPDRFSGSGSGTDFTLKISRVEAEDLGVYFCSQSTHVPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1313 - protein, 219 aa, Artificial
  antibody sequence
DVLMTQTPLSLPVSLGDQASISCRSSQTIVYSDGNTYLEWYLQKPGQSPKLLIYKVSNRFSGVPDRVSGSGSGTDFTLKISRVEAEDLGVYYCFQGSHVPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1314 - protein, 214 aa, Artificial
  antibody sequence
DIQMTQSPSSLSASLGERVSLTCRASQDIGNSLNWLQQKPDGTIKRLIYATSNLDSGVPKRFSGSRSGSDYSLTISSLESEDFVNYYCLQFASSPLTFGTGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1315 - protein, 215 aa, Artificial
  antibody sequence
QIVLTQSPAIMSASPGEKVTLTCSASSSVSSSYLFWYQQKPGSSPKLWIYSTSNLASGVPVRFSGSGFGTSYSLTISRMEAEDAASYFCHQWSSYPPTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

What is claimed:

1. An isolated antibody or a binding portion thereof that binds *Staphylococcus aureus* Leukocidin AB comprising:
(a) a variable heavy (VH) chain region comprising the CDR-H1 of SEQ ID NO: 1, the CDR-H2 of SEQ ID NO: 21, and the CDR-H3 of SEQ ID NO: 42 and
a variable light (VL) chain region comprising the CDR-L1 of SEQ ID NO: 63, the CDR-L2 of SEQ ID NO: 88, and the CDR-L3 of SEQ ID NO: 106, or
a variable light (VL) chain region comprising the CDR-L1 of SEQ ID NO: 64, the CDR-L2 of SEQ ID NO: 89, and the CDR-L3 of SEQ ID NO: 107;
(b) a variable heavy (VH) chain region comprising the CDR-H1 of SEQ ID NO: 2, the CDR-H2 of SEQ ID NO: 22, and the CDR-H3 of SEQ ID NO: 43 and
a variable light (VL) chain region comprising the CDR-L1 of SEQ ID NO: 65, the CDR-L2 of SEQ ID NO: 90, and the CDR-L3 of SEQ ID NO: 108;
(c) a variable heavy (VH) chain region comprising the CDR-H1 of SEQ ID NO: 2, the CDR-H2 of SEQ ID NO: 22, and the CDR-H3 of SEQ ID NO: 45 and
a variable light (VL) chain region comprising the CDR-L1 of SEQ ID NO: 67, the CDR-L2 of SEQ ID NO: 88, and the CDR-L3 of SEQ ID NO: 110;
(d) a variable heavy (VH) chain region comprising the CDR-H1 of SEQ ID NO: 3, the CDR-H2 of SEQ ID NO: 23, and the CDR-H3 of SEQ ID NO: 44 and
a variable light (VL) chain region comprising the CDR-L1 of SEQ ID NO: 66, the CDR-L2 of SEQ ID NO: 91, and the CDR-L3 of SEQ ID NO: 109;
(e) a variable heavy (VH) chain region comprising the CDR-H1 of SEQ ID NO: 4, the CDR-H2 of SEQ ID NO: 24, and the CDR-H3 of SEQ ID NO: 46 and
a variable light (VL) chain region comprising the CDR-L1 of SEQ ID NO: 68, the CDR-L2 of SEQ ID NO: 92, and the CDR-L3 of SEQ ID NO: 111;
(f) a variable heavy (VH) chain region comprising the CDR-H1 of SEQ ID NO: 5, the CDR-H2 of SEQ ID NO: 25, and the CDR-H3 of SEQ ID NO: 47 and
a variable light (VL) chain region comprising the CDR-L1 of SEQ ID NO: 69, the CDR-L2 of SEQ ID NO: 93, and the CDR-L3 of SEQ ID NO: 112;
(g) a variable heavy (VH) chain region comprising the CDR-H1 of SEQ ID NO: 6, the CDR-H2 of SEQ ID NO: 26, and the CDR-H3 of SEQ ID NO: 48 and
a variable light (VL) chain region comprising the CDR-L1 of SEQ ID NO: 70, the CDR-L2 of SEQ ID NO: 94, and the CDR-L3 of SEQ ID NO: 113;
(h) a variable heavy (VH) chain region comprising the CDR-H1 of SEQ ID NO: 7, the CDR-H2 of SEQ ID NO: 27, and the CDR-H3 of SEQ ID NO: 49 or
a variable heavy (VH) chain region comprising the CDR-H1 of SEQ ID NO: 10, the CDR-H2 of SEQ ID NO: 30, and the CDR-H3 of SEQ ID NO: 52 and
a variable light (VL) chain region comprising the CDR-L1 of SEQ ID NO: 71, the CDR-L2 of SEQ ID NO: 95, and the CDR-L3 of SEQ ID NO: 114;
(i) a variable heavy (VH) chain region comprising the CDR-H1 of SEQ ID NO: 8, the CDR-H2 of SEQ ID NO: 28, and the CDR-H3 of SEQ ID NO: 50 and
a variable light (VL) chain region comprising the CDR-L1 of SEQ ID NO: 72, the CDR-L2 of SEQ ID NO: 96, and the CDR-L3 of SEQ ID NO: 115;
(j) a variable heavy (VH) chain region comprising the CDR-H1 of SEQ ID NO: 9, the CDR-H2 of SEQ ID NO: 29, and the CDR-H3 of SEQ ID NO: 51 and
a variable light (VL) chain region comprising the CDR-L1 of SEQ ID NO: 73, the CDR-L2 of SEQ ID NO: 97, and the CDR-L3 of SEQ ID NO: 116;
(k) a variable heavy (VH) chain region comprising the CDR-H1 of SEQ ID NO: 11, the CDR-H2 of SEQ ID NO: 31, and the CDR-H3 of SEQ ID NO: 53 and
a variable light (VL) chain region comprising the CDR-L1 of SEQ ID NO: 66, the CDR-L2 of SEQ ID NO: 92, and the CDR-L3 of SEQ ID NO: 117;
(l) a variable heavy (VH) chain region comprising the CDR-H1 of SEQ ID NO: 12, the CDR-H2 of SEQ ID NO: 32, and the CDR-H3 of SEQ ID NO: 54 and
a variable light (VL) chain region comprising the CDR-L1 of SEQ ID NO: 74, the CDR-L2 of SEQ ID NO: 89, and the CDR-L3 of SEQ ID NO: 118 or
a variable light (VL) chain region comprising the CDR-L1 of SEQ ID NO: 75, the CDR-L2 of SEQ ID NO: 98, and the CDR-L3 of SEQ ID NO: 119;
(m) a variable heavy (VH) chain region comprising the CDR-H1 of SEQ ID NO: 13, the CDR-H2 of SEQ ID NO: 33, and the CDR-H3 of SEQ ID NO: 55 and
a variable light (VL) chain region comprising the CDR-L1 of SEQ ID NO: 76, the CDR-L2 of SEQ ID NO: 96, and the CDR-L3 of SEQ ID NO: 120;
(n) a variable heavy (VH) chain region comprising the CDR-H1 of SEQ ID NO: 14, the CDR-H2 of SEQ ID NO: 34, and the CDR-H3 of SEQ ID NO: 56 or
a variable heavy (VH) chain region comprising the CDR-H1 of SEQ ID NO: 14, the CDR-H2 of SEQ ID NO: 35, and the CDR-H3 of SEQ ID NO: 56 and
a variable light (VL) chain region comprising the CDR-L1 of SEQ ID NO: 77, the CDR-L2 of SEQ ID NO: 99, and the CDR-L3 of SEQ ID NO: 121;
(o) a variable heavy (VH) chain region comprising the CDR-H1 of SEQ ID NO: 15, the CDR-H2 of SEQ ID NO: 36, and the CDR-H3 of SEQ ID NO: 57 and
a variable light (VL) chain region comprising the CDR-L1 of SEQ ID NO: 78, the CDR-L2 of SEQ ID NO: 100, and the CDR-L3 of SEQ ID NO: 122;
(p) a variable heavy (VH) chain region comprising the CDR-H1 of SEQ ID NO: 16, the CDR-H2 of SEQ ID NO: 37, and the CDR-H3 of SEQ ID NO: 58 and a variable light (VL) chain region comprising the CDR-L1 of SEQ ID NO: 78, the CDR-L2 of SEQ ID NO: 99, and the CDR-L3 of SEQ ID NO: 123;

(q) a variable heavy (VH) chain region comprising the CDR-H1 of SEQ ID NO: 17, the CDR-H2 of SEQ ID NO: 38, and the CDR-H3 of SEQ ID NO: 59 and a variable light (VL) chain region comprising the CDR-L1 of SEQ ID NO: 79, the CDR-L2 of SEQ ID NO: 101, and the CDR-L3 of SEQ ID NO: 124;

(r) a variable heavy (VH) chain region comprising the CDR-H1 of SEQ ID NO: 18, the CDR-H2 of SEQ ID NO: 39, and the CDR-H3 of SEQ ID NO: 60 and a variable light (VL) chain region comprising the CDR-L1 of SEQ ID NO: 80, the CDR-L2 of SEQ ID NO: 96, and the CDR-L3 of SEQ ID NO: 120;

(s) a variable heavy (VH) chain region comprising the CDR-H1 of SEQ ID NO: 19, the CDR-H2 of SEQ ID NO: 40, and the CDR-H3 of SEQ ID NO: 61 and a variable light (VL) chain region comprising the CDR-L1 of SEQ ID NO: 66, the CDR-L2 of SEQ ID NO: 92, and the CDR-L3 of SEQ ID NO: 125; or (t) a variable heavy (VH) chain region comprising the CDR-H1 of SEQ ID NO: 20, the CDR-H2 of SEQ ID NO: 41, and the CDR-H3 of SEQ ID NO: 62 and a variable light (VL) chain region comprising the CDR-L1 of SEQ ID NO: 71, the CDR-L2 of SEQ ID NO: 95, and the CDR-L3 of SEQ ID NO: 114 or
a variable light (VL) chain region comprising the CDR-L1 of SEQ ID NO: 81, the CDR-L2 of SEQ ID NO: 102, and the CDR-L3 of SEQ ID NO: 126 or
a variable light (VL) chain region comprising the CDR-L1 of SEQ ID NO: 69, the CDR-L2 of SEQ ID NO: 93, and the CDR-L3 of SEQ ID NO: 127 or
a variable light (VL) chain region comprising the CDR-L1 of SEQ ID NO: 79, the CDR-L2 of SEQ ID NO: 101, and the CDR-L3 of SEQ ID NO: 128 or
a variable light (VL) chain region comprising the CDR-L1 of SEQ ID NO: 82, the CDR-L2 of SEQ ID NO: 103, and the CDR-L3 of SEQ ID NO: 129 or
a variable light (VL) chain region comprising the CDR-L1 of SEQ ID NO: 75, the CDR-L2 of SEQ ID NO: 98, and the CDR-L3 of SEQ ID NO: 119 or
a variable light (VL) chain region comprising the CDR-L1 of SEQ ID NO: 83, the CDR-L2 of SEQ ID NO: 104, and the CDR-L3 of SEQ ID NO: 130 or
a variable light (VL) chain region comprising the CDR-L1 of SEQ ID NO: 84, the CDR-L2 of SEQ ID NO: 88, and the CDR-L3 of SEQ ID NO: 131 or
a variable light (VL) chain region comprising the CDR-L1 of SEQ ID NO: 74, the CDR-L2 of SEQ ID NO: 89, and the CDR-L3 of SEQ ID NO: 132 or
a variable light (VL) chain region comprising the CDR-L1 of SEQ ID NO: 74, the CDR-L2 of SEQ ID NO: 89, and the CDR-L3 of SEQ ID NO: 133 or
a variable light (VL) chain region comprising the CDR-L1 of SEQ ID NO: 66, the CDR-L2 of SEQ ID NO: 92, and the CDR-L3 of SEQ ID NO: 125 or
a variable light (VL) chain region comprising the CDR-L1 of SEQ ID NO: 70, the CDR-L2 of SEQ ID NO: 94, and the CDR-L3 of SEQ ID NO: 113 or
a variable light (VL) chain region comprising the CDR-L1 of SEQ ID NO: 85, the CDR-L2 of SEQ ID NO: 105, and the CDR-L3 of SEQ ID NO: 134 or
a variable light (VL) chain region comprising the CDR-L1 of SEQ ID NO: 86, the CDR-L2 of SEQ ID NO: 96, and the CDR-L3 of SEQ ID NO: 135 or
a variable light (VL) chain region comprising the CDR-L1 of SEQ ID NO: 87, the CDR-L2 of SEQ ID NO: 99, and the CDR-L3 of SEQ ID NO: 122.

2. The isolated antibody or a binding portion thereof of claim 1 comprising
a variable heavy (VH) chain region comprising the CDR-H1 of SEQ ID NO: 11, the CDR-H2 of SEQ ID NO: 31, and the CDR-H3 of SEQ ID NO: 53 and
a variable light (VL) chain region comprising the CDR-L1 of SEQ ID NO: 66, the CDR-L2 of SEQ ID NO: 92, and the CDR-L3 of SEQ ID NO: 117.

3. The isolated antibody or a binding portion thereof of claim 2, wherein said antibody neutralizes *S. aureus* leucocidin AB cytolytic activity.

4. An isolated antibody or a binding portion thereof that binds *Staphylococcus aureus* Leukocidin AB comprising a variable light (VL) chain comprising respectively the amino acid sequence of SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175 and SEQ ID NO: 176 and a variable heavy (VH) chain comprising respectively the amino acid sequence of SEQ ID NO: SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, SEQ ID NO: 203, SEQ ID NO: 204, SEQ ID NO: 205, SEQ ID NO: 206, SEQ ID NO: 207, SEQ ID NO: 208, SEQ ID NO: 209, SEQ ID NO: 210, SEQ ID NO: 211, SEQ ID NO: 212, SEQ ID NO: 213, SEQ ID NO: 214, SEQ ID NO: 215, SEQ ID NO: 216 and SEQ ID NO: 217.

* * * * *